US011136566B2

(12) United States Patent
Duchateau et al.

(10) Patent No.: US 11,136,566 B2
(45) Date of Patent: Oct. 5, 2021

(54) TALE-PROTEIN SCAFFOLDS AND USES THEREOF

(71) Applicant: CELLECTIS, Paris (FR)

(72) Inventors: Philippe Duchateau, Draveil (FR); Alexandre Juillerat, Paris (FR); Julien Valton, Charenton le Pont (FR); Claudia Bertonati, Paris (FR); Jean-Charles Epinat, Les Lilas (FR); George H. Silva, Le Plessis Trevis (FR)

(73) Assignee: Cellectis, Paris (FR)

( * ) Notice: Subject to any disclaimer, the term of this patent is extended or adjusted under 35 U.S.C. 154(b) by 1 day.

(21) Appl. No.: 16/237,901

(22) Filed: Jan. 2, 2019

(65) Prior Publication Data

US 2019/0316100 A1 Oct. 17, 2019

Related U.S. Application Data

(63) Continuation of application No. 14/009,509, filed as application No. PCT/US2012/032439 on Apr. 5, 2012, now abandoned.

(60) Provisional application No. 61/496,454, filed on Jun. 13, 2011, provisional application No. 61/499,043, filed on Jun. 20, 2011, provisional application No. 61/499,047, filed on Jun. 20, 2011, provisional application No. 61/472,065, filed on Apr. 5, 2011, provisional application No. 61/533,123, filed on Sep. 9, 2011, provisional application No. 61/533,098, filed on Sep. 9, 2011, provisional application No. 61/579,544, filed on Dec. 22, 2011.

(51) Int. Cl.

| | |
|---|---|
| ***C12N 9/16*** | (2006.01) |
| ***C12N 15/63*** | (2006.01) |
| ***C12N 5/071*** | (2010.01) |
| ***C12N 5/10*** | (2006.01) |
| ***C07K 14/195*** | (2006.01) |
| ***C12N 9/22*** | (2006.01) |
| *C07K 14/47* | (2006.01) |
| *A61K 38/00* | (2006.01) |
| *C12P 19/34* | (2006.01) |

(52) U.S. Cl.

CPC .............. *C12N 9/16* (2013.01); *C07K 14/195* (2013.01); *C12N 5/0602* (2013.01); *C12N 5/10* (2013.01); *C12N 9/22* (2013.01); *C12N 15/63* (2013.01); *A61K 38/00* (2013.01); *C07K 14/4703* (2013.01); *C07K 2319/00* (2013.01); *C07K 2319/07* (2013.01); *C07K 2319/80* (2013.01); *C12P 19/34* (2013.01)

(58) Field of Classification Search

CPC ........ C12N 9/16; C12N 15/63; C12N 5/0602; C12N 5/10; C12N 9/22; C07K 14/195; C07K 2319/07; C07K 2319/00; C07K 2319/80

USPC ................................ 435/366, 196, 199, 455

See application file for complete search history.

(56) References Cited

U.S. PATENT DOCUMENTS

| | | | | |
|---|---|---|---|---|
| 8,673,557 | B2 | 3/2014 | Scharenberg et al. | |
| 2011/0145940 | A1* | 6/2011 | Voytas .................. | C12N 15/63 800/13 |

OTHER PUBLICATIONS

Minczuk et al. (2008) Nucleic Acids Research, vol. 36(12), 3926-3938.*

Looney et al. (1989) Gene, vol. 80, 193-208.*

Boch et al. (2009) Science, vol. 326, 1509-1512.*

Li et al. (2010) J. Biol. Chem., vol. 285(20),14871-14881.*

Christian, M. et al., "Targeting DNA Double-Strand Breaks with TAL Effector Nucleases", Genetics (2010); vol. 186:2, pp. 757-761.

Li, T. et al., "TAL nucleases (TALNs): hybrid proteins composed of TAL effectors and FokI DNA-cleavage domain", Nucleic Acids Research (2011); vol. 39:1; pp. 359-372.

Mahfouz, M.M. et al., "De novo-engineered transcription activator-like effector (TALE) hybrid nuclease with novel DNA binding specificity creates double-strand breaks", PNAS (2011); vol. 108:6, pp. 2623-2628.

Scholze, H. et al., "TAL effectors are remote controls for gene activation", Current Opinion in Microbiology (2011); vol. 14:1, pp. 47-53.

West et al, Evidence That the Intron Open Reading Frame of the Phage T4 td Gen Encodes a Specific Endonuclease (1989) J. Biol. Chem., vol. 264, 10343-10346.

Mazur et al., Identification and Expression of the TREX1 and TREX2 cDNA Sequences Ecoding Mammalian 3'-5' Exonucleases, (1999) J. Bio. Chem., vol. 274, 19655-19660.

Looney et al., Nucleotide sequence of the FokI restriction-modification system: separate strand-specificity domains in the methyltransferase, (1989) Gene, vol. 80, 193-208.

* cited by examiner

*Primary Examiner* — Anne Marie S Wehbe

(74) *Attorney, Agent, or Firm* — Arrigo, Lee, Guttman & Mouta-Bellum LLP

(57) ABSTRACT

The present invention relates to new Transcription Activator-Like Effector proteins and more particularly new Transcription Activator-Like Effector Nucleases (TALENs) that can efficiently target and process nucleic acids. The present invention also concerns methods to use these new Transcription Activator-Like Effector proteins. The present invention also relates to vectors, compositions and kits in which Transcription Activator-Like Effector proteins of the present invention are used.

17 Claims, 45 Drawing Sheets

Figure 1:
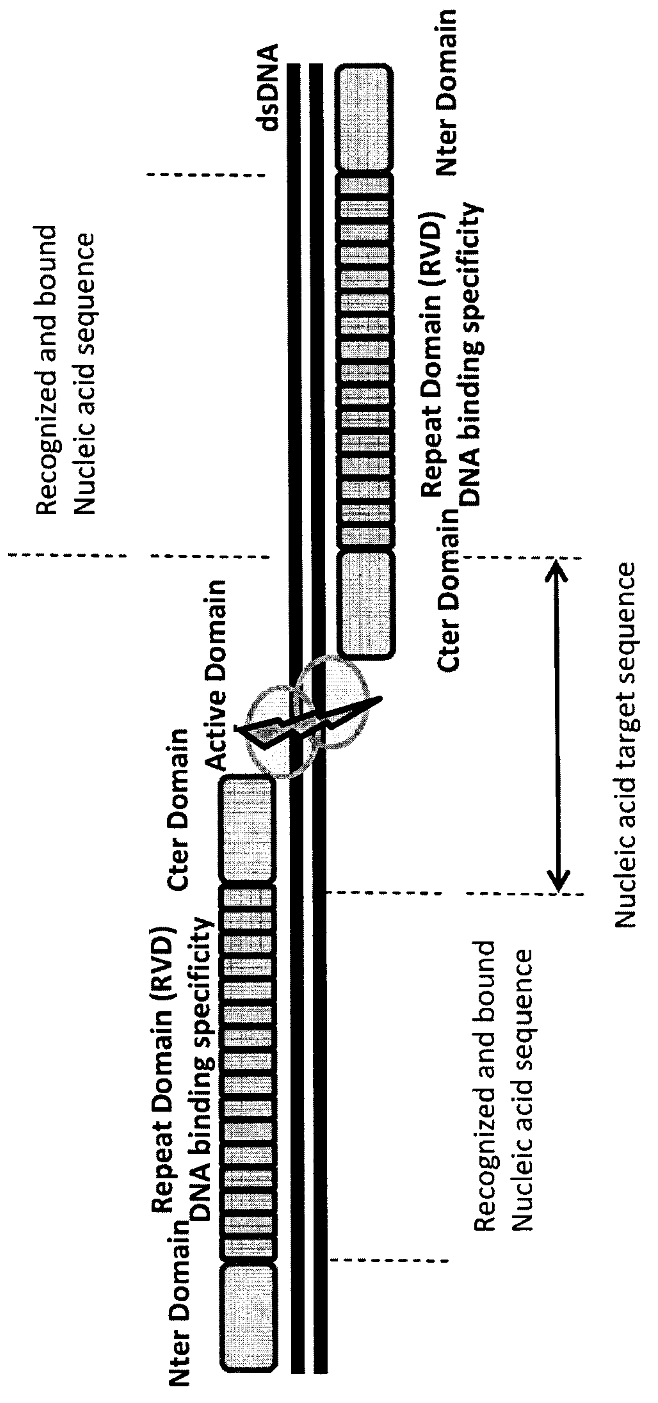

Specification includes a Sequence Listing.

C0- AvrBs3-derived TALEN

C40- AvrBs3-derived TALEN

C64- AvrBs3-derived TALEN

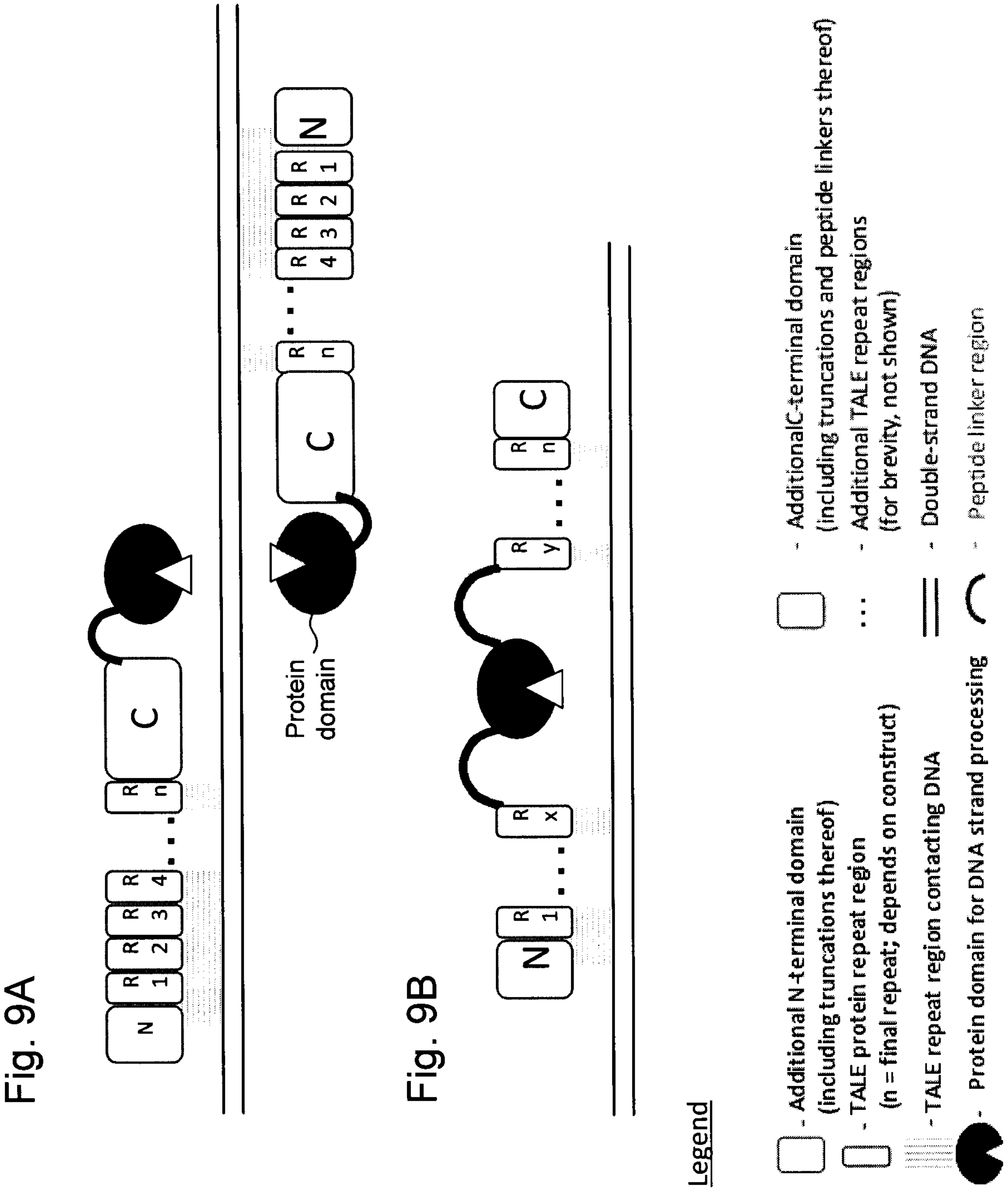
Fig. 9A
N
R 1
R 2
R 3
R 4
R n
C
Protein domain
C
R n
R 4
R 3
R 2
R 1
N
Fig. 9B
N
R 1
R x
R y
R n
C
Legend
- Additional N-terminal domain (including truncations thereof)
- TALE protein repeat region (n = final repeat; depends on construct)
- TALE repeat region contacting DNA
- Protein domain for DNA strand processing
- AdditionalC-terminal domain (including truncations and peptide linkers thereof)
- Additional TALE repeat regions (for brevity, not shown)
- Double-strand DNA
- Peptide linker region

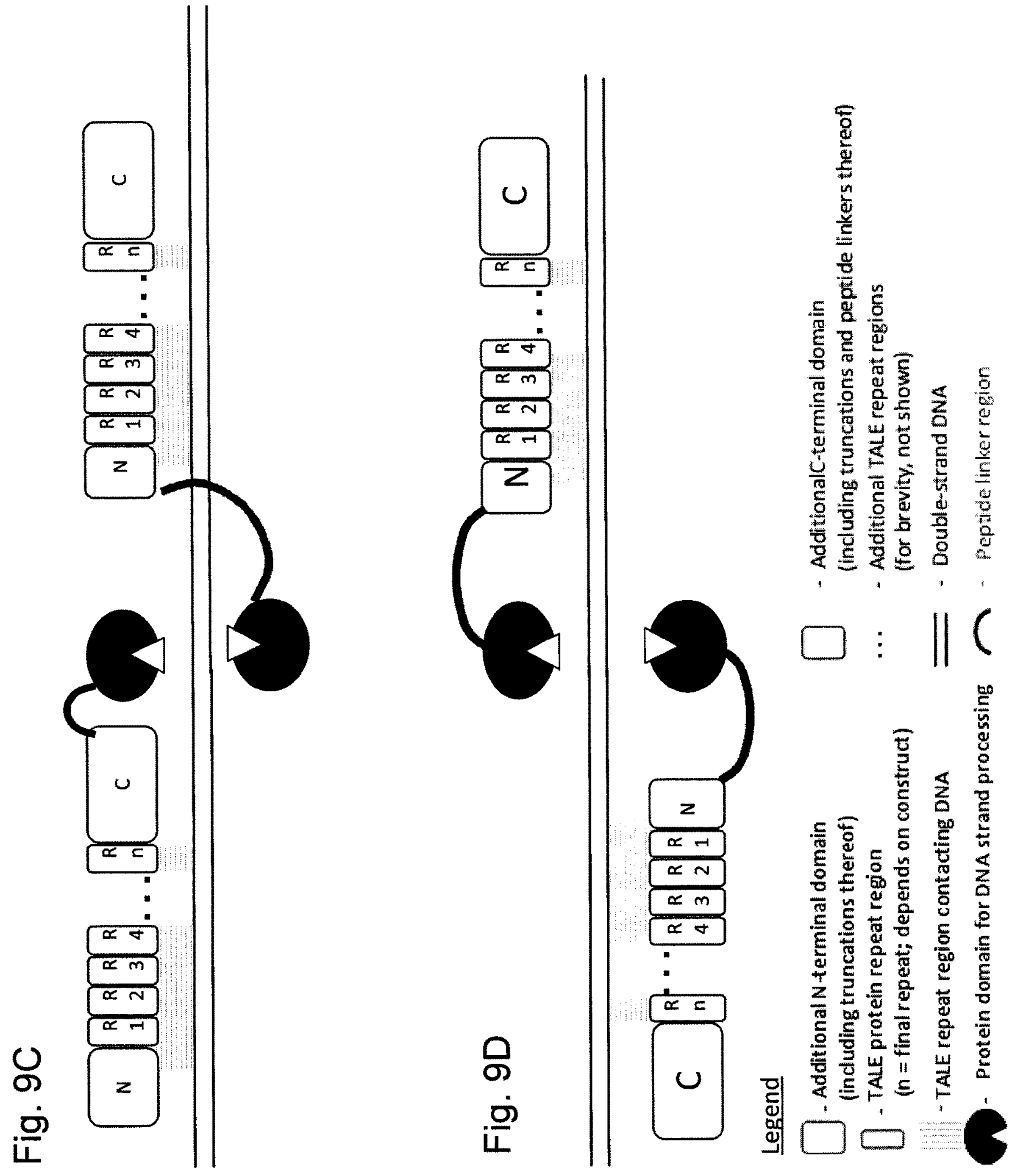
Fig. 9C
N
R 1
R 2
R 3
R 4
R n
C
Fig. 9D
Legend
- Additional N-terminal domain (including truncations thereof)
- TALE protein repeat region (n = final repeat; depends on construct)
- TALE repeat region contacting DNA
- Protein domain for DNA strand processing
- Additional C-terminal domain (including truncations and peptide linkers thereof)
- Additional TALE repeat regions (for brevity, not shown)
- Double-strand DNA
- Peptide linker region

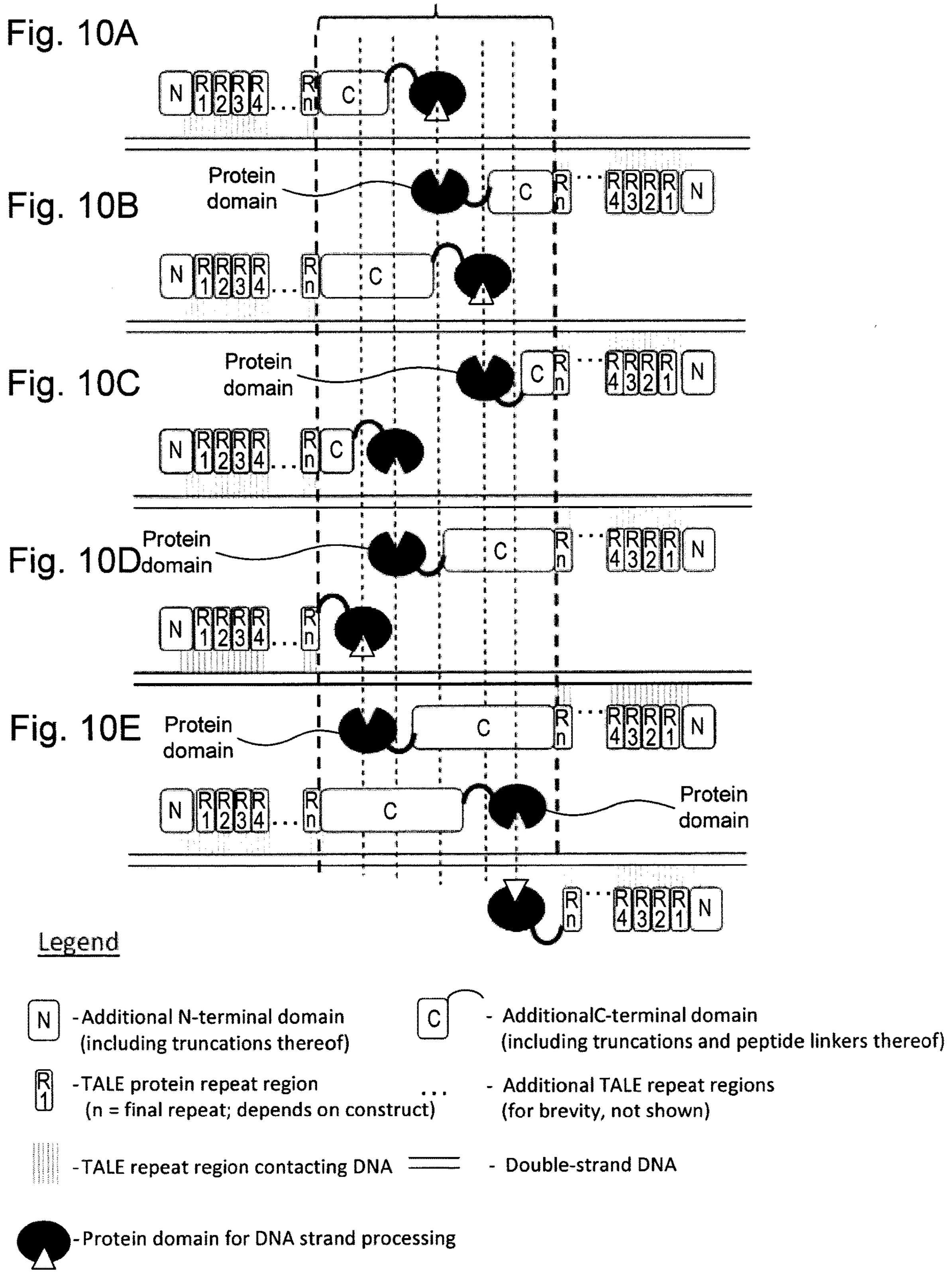
Fig. 10A
N
R1 R2 R3 R4 ... Rn
C
Fig. 10B
Protein domain
C Rn ... R4 R3 R2 R1 N
N R1 R2 R3 R4 ... Rn C
Fig. 10C
Protein domain
C Rn ... R4 R3 R2 R1 N
N R1 R2 R3 R4 ... Rn C
Fig. 10D
Protein domain
C Rn ... R4 R3 R2 R1 N
N R1 R2 R3 R4 ... Rn
Fig. 10E
Protein domain
C Rn ... R4 R3 R2 R1 N
N R1 R2 R3 R4 ... Rn C
Protein domain
Rn ... R4 R3 R2 R1 N
Legend
N -Additional N-terminal domain (including truncations thereof)
C - AdditionalC-terminal domain (including truncations and peptide linkers thereof)
R1 -TALE protein repeat region (n = final repeat; depends on construct)
... - Additional TALE repeat regions (for brevity, not shown)
-TALE repeat region contacting DNA
- Double-strand DNA
-Protein domain for DNA strand processing

Fig. 12

| Spacer length [bp] | Neg. Control | cT11Avr_TevD01 | cT11Avr_TevD02 |
|---|---|---|---|
| 5 | n.d. | n.d. | n.d. |
| 6 | n.d. | n.d. | n.d. |
| 7 | n.d. | n.d. | n.d. |
| 8 | n.d. | n.d. | n.d. |
| 9 | n.d. | n.d. | n.d. |
| 10 | n.d. | + | + |
| 11 | n.d. | +++ | + |
| 12 | n.d. | + | + |
| 13 | n.d. | + | + |
| 14 | n.d. | n.d. | n.d. |
| 15 | n.d. | +++ | +++ |
| 16 | n.d. | + | + |
| 17 | n.d. | n.d. | n.d. |
| 18 | n.d. | n.d. | n.d. |
| 19 | n.d. | + | n.d. |
| 20 | n.d. | n.d. | n.d. |
| 21 | n.d. | + | + |
| 22 | n.d. | +++ | +++ |
| 23 | n.d. | +++ | +++ |
| 24 | n.d. | +++ | +++ |
| 25 | n.d. | +++ | +++ |
| 26 | n.d. | +++ | +++ |
| 27 | n.d. | +++ | +++ |
| 28 | n.d. | + | + |
| 29 | n.d. | n.d. | n.d. |
| 30 | n.d. | n.d. | n.d. |

| Spacer length [bp] | pCLS9596 | pCLS9597 | pCLS9599 |
|---|---|---|---|
| 5 | +++ | +++ | +++ |
| 6 | +++ | +++ | +++ |
| 7 | +++ | +++ | +++ |
| 8 | +++ | +++ | +++ |
| 9 | +++ | +++ | +++ |
| 10 | +++ | +++ | +++ |
| 11 | +++ | +++ | +++ |
| 12 | +++ | +++ | +++ |
| 13 | +++ | +++ | +++ |
| 14 | +++ | +++ | +++ |
| 15 | +++ | +++ | +++ |
| 16 | +++ | +++ | +++ |
| 17 | +++ | +++ | +++ |
| 18 | +++ | +++ | +++ |
| 19 | +++ | +++ | +++ |
| 20 | +++ | +++ | +++ |
| 21 | +++ | +++ | +++ |
| 22 | +++ | +++ | +++ |
| 23 | +++ | +++ | +++ |
| 24 | +++ | +++ | +++ |
| 25 | +++ | +++ | +++ |
| 26 | +++ | +++ | +++ |
| 27 | +++ | +++ | +++ |
| 28 | +++ | +++ | +++ |
| 29 | +++ | +++ | +++ |
| 30 | +++ | +++ | +++ |
| 31 | +++ | +++ | +++ |
| 32 | +++ | +++ | +++ |
| 33 | +++ | +++ | +++ |
| 34 | +++ | +++ | +++ |
| 35 | +++ | +++ | +++ |
| 36 | +++ | +++ | +++ |
| 37 | +++ | +++ | +++ |
| 38 | +++ | +++ | +++ |
| 39 | +++ | +++ | +++ |
| 40 | ++ | ++ | +++ |
| compact | +++ | +++ | +++ |
| neg ctrl | n.d. | n.d. | n.d. |

Fig. 14

| Spacer length [bp] | pCLS8589 |
|---|---|
| 5 | +++ |
| 6 | +++ |
| 7 | +++ |
| 8 | +++ |
| 9 | +++ |
| 10 | ++ |
| 11 | +++ |
| 12 | +++ |
| 13 | +++ |
| 14 | ++ |
| 15 | ++ |
| 16 | +++ |
| 17 | +++ |
| 18 | +++ |
| 19 | +++ |
| 20 | +++ |
| 21 | ++ |
| 22 | +++ |
| 23 | +++ |
| 24 | +++ |
| 25 | +++ |
| 26 | +++ |
| 27 | +++ |
| 28 | +++ |
| 29 | +++ |
| 30 | +++ |
| 31 | +++ |
| 32 | +++ |
| 33 | +++ |
| 34 | +++ |
| 35 | +++ |
| 36 | +++ |
| 37 | ++ |
| 38 | ++ |
| 39 | ++ |
| 40 | ++ |
| compact | ++ |
| neg ctrl | n.d. |

Fig. 15

Fig. 16

| RAGT2R derived constructs | C0 | | | | |
|---|---|---|---|---|---|
| AvrBs3 derived constructs | C0 | C11 | C40 | C115 | Cter WT |
| spacer length [bp] | | | | | |
| 05 | n.d. | n.d. | n.d. | n.d. | n.d. |
| 06 | n.d. | n.d. | + | n.d. | n.d. |
| 07 | n.d. | n.d. | n.d. | n.d. | n.d. |
| 08 | +++ | + | + | n.d. | n.d. |
| 09 | +++ | +++ | +++ | n.d. | n.d. |
| 10 | +++ | +++ | +++ | + | n.d. |
| 11 | +++ | +++ | +++ | ++ | ++ |
| 12 | +++ | +++ | +++ | +++ | +++ |
| 13 | +++ | +++ | +++ | +++ | +++ |
| 14 | +++ | +++ | +++ | +++ | +++ |
| 15 | +++ | +++ | +++ | +++ | +++ |
| 16 | +++ | +++ | +++ | +++ | +++ |
| 17 | +++ | +++ | +++ | +++ | +++ |
| 18 | +++ | +++ | +++ | ++ | ++ |
| 19 | +++ | +++ | +++ | +++ | ++ |
| 20 | +++ | +++ | +++ | +++ | +++ |
| 21 | +++ | +++ | +++ | +++ | +++ |
| 22 | +++ | +++ | +++ | +++ | +++ |
| 23 | +++ | +++ | +++ | +++ | +++ |
| 24 | ++ | +++ | +++ | +++ | +++ |
| 25 | ++ | +++ | +++ | +++ | +++ |
| 26 | ++ | ++ | ++ | ++ | +++ |
| 27 | +++ | +++ | ++ | ++ | +++ |
| 28 | +++ | +++ | ++ | ++ | +++ |
| 29 | ++ | +++ | +++ | +++ | ++ |
| 30 | ++ | +++ | +++ | +++ | ++ |
| 31 | ++ | +++ | +++ | ++ | ++ |
| 32 | + | ++ | ++ | + | ++ |
| 33 | + | ++ | ++ | + | ++ |
| 34 | + | + | + | + | ++ |
| 35 | + | + | + | +/- | ++ |
| 36 | + | + | + | + | +++ |
| 37 | + | + | + | + | +++ |
| 38 | + | + | + | + | ++ |
| 39 | + | + | + | + | ++ |
| 40 | + | + | + | + | + |

Fig. 17

| RAGT2R derived constructs | C11 | | | | |
|---|---|---|---|---|---|
| AvrBs3 derived constructs | C0 | C11 | C40 | C115 | Cter WT |
| spacer length [bp] | | | | | |
| 05 | n.d. | n.d. | n.d. | n.d. | n.d. |
| 06 | n.d. | n.d. | n.d. | n.d. | n.d. |
| 07 | n.d. | n.d. | n.d. | n.d. | n.d. |
| 08 | + | n.d. | n.d. | n.d. | n.d. |
| 09 | +++ | ++ | ++ | n.d. | n.d. |
| 10 | +++ | +++ | +++ | n.d. | n.d. |
| 11 | +++ | +++ | +++ | + | ++ |
| 12 | +++ | +++ | +++ | +++ | +++ |
| 13 | +++ | +++ | +++ | +++ | +++ |
| 14 | +++ | +++ | +++ | +++ | +++ |
| 15 | +++ | +++ | +++ | +++ | +++ |
| 16 | +++ | +++ | +++ | +++ | +++ |
| 17 | +++ | +++ | +++ | +++ | +++ |
| 18 | +++ | +++ | +++ | +++ | +++ |
| 19 | +++ | +++ | +++ | +++ | +++ |
| 20 | +++ | +++ | +++ | +++ | +++ |
| 21 | +++ | +++ | +++ | +++ | +++ |
| 22 | +++ | +++ | +++ | +++ | +++ |
| 23 | +++ | +++ | +++ | +++ | +++ |
| 24 | +++ | +++ | +++ | +++ | +++ |
| 25 | +++ | +++ | +++ | +++ | +++ |
| 26 | ++ | +++ | +++ | ++ | +++ |
| 27 | ++ | + | +++ | ++ | +++ |
| 28 | + | + | + | ++ | +++ |
| 29 | ++ | ++ | ++ | +++ | +++ |
| 30 | ++ | ++ | ++ | +++ | +++ |
| 31 | ++ | ++ | ++ | ++ | ++ |
| 32 | + | ++ | ++ | ++ | ++ |
| 33 | ++ | + | ++ | + | ++ |
| 34 | ++ | ++ | ++ | + | ++ |
| 35 | ++ | ++ | ++ | + | ++ |
| 36 | + | ++ | ++ | + | +++ |
| 37 | + | + | + | n.d. | +++ |
| 38 | +/- | +/- | + | +/- | ++ |
| 39 | + | + | +/- | + | +++ |
| 40 | + | + | +/- | + | ++ |

Fig. 18

| RAGT2R derived constructs | C40 | | | | |
|---|---|---|---|---|---|
| AvrBs3 derived constructs | C0 | C11 | C40 | C115 | Cter WT |
| spacer length [bp] | | | | | |
| 05 | n.d. | n.d. | n.d. | n.d. | n.d. |
| 06 | n.d. | n.d. | n.d. | n.d. | n.d. |
| 07 | n.d. | n.d. | n.d. | n.d. | n.d. |
| 08 | ++ | n.d. | n.d. | n.d. | n.d. |
| 09 | +++ | ++ | ++ | n.d. | n.d. |
| 10 | +++ | +++ | +++ | n.d. | n.d. |
| 11 | +++ | +++ | +++ | + | + |
| 12 | +++ | +++ | +++ | ++ | ++ |
| 13 | +++ | +++ | +++ | +++ | +++ |
| 14 | +++ | +++ | +++ | +++ | +++ |
| 15 | +++ | +++ | +++ | +++ | +++ |
| 16 | +++ | +++ | +++ | +++ | +++ |
| 17 | ++ | +++ | +++ | +++ | +++ |
| 18 | +++ | +++ | +++ | +++ | +++ |
| 19 | +++ | +++ | +++ | +++ | +++ |
| 20 | +++ | +++ | +++ | +++ | +++ |
| 21 | +++ | +++ | +++ | +++ | +++ |
| 22 | +++ | +++ | +++ | +++ | +++ |
| 23 | +++ | +++ | +++ | +++ | +++ |
| 24 | +++ | +++ | +++ | +++ | +++ |
| 25 | +++ | +++ | +++ | +++ | +++ |
| 26 | ++ | +++ | +++ | ++ | +++ |
| 27 | + | +++ | +++ | +++ | +++ |
| 28 | + | + | ++ | ++ | +++ |
| 29 | ++ | ++ | ++ | +++ | +++ |
| 30 | ++ | ++ | ++ | +++ | +++ |
| 31 | ++ | ++ | ++ | ++ | +++ |
| 32 | + | ++ | ++ | ++ | ++ |
| 33 | + | ++ | + | ++ | +++ |
| 34 | + | ++ | + | + | ++ |
| 35 | ++ | ++ | ++ | + | +++ |
| 36 | + | ++ | ++ | + | ++ |
| 37 | + | + | + | n.d. | ++ |
| 38 | +/- | + | + | + | +++ |
| 39 | +/- | + | +/- | + | +++ |
| 40 | +/- | +/- | +/- | + | +++ |

Fig. 19A

| RAGT2R derived constructs | Cter WT | | | | |
|---|---|---|---|---|---|
| AvrBs3 derived constructs | C0 | C11 | C40 | C115 | Cter WT |
| spacer length [bp] | | | | | |
| 05 | n.d. | n.d. | n.d. | n.d. | n.d. |
| 06 | n.d. | n.d. | n.d. | n.d. | n.d. |
| 07 | n.d. | n.d. | n.d. | n.d. | n.d. |
| 08 | n.d. | n.d. | n.d. | n.d. | n.d. |
| 09 | n.d. | n.d. | n.d. | n.d. | n.d. |
| 10 | ++ | + | n.d. | n.d. | n.d. |
| 11 | ++ | ++ | + | n.d. | n.d. |
| 12 | +++ | +++ | ++ | n.d. | n.d. |
| 13 | +++ | +++ | +++ | ++ | ++ |
| 14 | +++ | +++ | +++ | ++ | ++ |
| 15 | +++ | +++ | +++ | ++ | ++ |
| 16 | +++ | +++ | +++ | +++ | +++ |
| 17 | +++ | +++ | +++ | +++ | ++ |
| 18 | +++ | +++ | +++ | ++ | + |
| 19 | +++ | +++ | +++ | ++ | + |
| 20 | +++ | +++ | +++ | ++ | + |
| 21 | +++ | +++ | +++ | ++ | + |
| 22 | +++ | +++ | +++ | +++ | ++ |
| 23 | +++ | +++ | +++ | +++ | ++ |
| 24 | +++ | +++ | +++ | +++ | ++ |
| 25 | +++ | +++ | +++ | +++ | +++ |
| 26 | +++ | +++ | +++ | ++ | +++ |
| 27 | +++ | +++ | +++ | +++ | +++ |
| 28 | +++ | +++ | +++ | ++ | ++ |
| 29 | +++ | +++ | +++ | +++ | ++ |
| 30 | +++ | +++ | +++ | +++ | ++ |
| 31 | +++ | +++ | +++ | ++ | ++ |
| 32 | +++ | +++ | +++ | +++ | ++ |
| 33 | +++ | +++ | +++ | ++ | + |
| 34 | +++ | +++ | +++ | + | ++ |
| 35 | +++ | +++ | +++ | + | ++ |
| 36 | +++ | +++ | +++ | + | ++ |
| 37 | +++ | +++ | +++ | + | ++ |
| 38 | ++ | +++ | +++ | ++ | + |
| 39 | +++ | +++ | +++ | ++ | ++ |
| 40 | +++ | +++ | +++ | ++ | ++ |

Fig. 19B

| spacer length [bp] | pCLS9600 | pCLS9601 | pCLS9602 | pCLS9603 | pCLS9604 |
|---|---|---|---|---|---|
| 05 | + | + | + | + | + |
| 06 | + | + | + | + | + |
| 07 | + | + | + | + | + |
| 08 | + | + | + | + | + |
| 09 | + | + | + | + | + |
| 10 | + | + | ++ | + | + |
| 11 | + | ++ | ++ | + | n.d. |
| 12 | + | + | ++ | + | + |
| 13 | + | + | ++ | ++ | + |
| 14 | + | + | + | + | n.d. |
| 15 | ++ | ++ | ++ | ++ | + |
| 16 | + | ++ | + | ++ | + |
| 17 | + | + | + | + | + |
| 18 | + | + | + | + | + |
| 19 | + | + | + | + | + |
| 20 | + | + | + | + | + |
| 21 | + | + | ++ | + | + |
| 22 | + | + | + | + | + |
| 23 | + | ++ | ++ | + | + |
| 24 | + | ++ | ++ | + | + |
| 25 | + | ++ | ++ | + | + |
| 26 | + | ++ | ++ | + | + |
| 27 | + | ++ | ++ | + | ++ |
| 28 | + | ++ | ++ | + | ++ |
| 29 | + | ++ | ++ | + | ++ |
| 30 | + | ++ | ++ | + | ++ |
| 31 | + | ++ | ++ | + | + |
| 32 | + | ++ | ++ | + | + |
| 33 | + | + | + | + | + |
| 34 | + | + | + | + | + |
| 35 | + | + | + | + | + |
| 36 | + | + | + | + | + |
| 37 | + | + | + | + | + |
| 38 | + | + | + | + | + |
| 39 | + | + | + | + | + |
| 40 | + | + | + | + | + |

Fig. 20

| spacer length [bp] | pCLS9600 | pCLS9601 | pCLS9602 | pCLS9603 | pCLS9604 |
|---|---|---|---|---|---|
| 05 | + | + | + | + | + |
| 06 | + | + | + | + | + |
| 07 | + | + | + | + | + |
| 08 | + | + | + | + | + |
| 09 | + | + | + | + | + |
| 10 | + | + | ++ | + | + |
| 11 | + | ++ | ++ | + | n.d. |
| 12 | + | + | ++ | + | + |
| 13 | + | + | ++ | ++ | + |
| 14 | + | + | + | + | n.d. |
| 15 | ++ | ++ | ++ | ++ | + |
| 16 | + | ++ | + | ++ | + |
| 17 | + | + | + | + | + |
| 18 | + | + | + | + | + |
| 19 | + | + | + | + | + |
| 20 | + | + | + | + | + |
| 21 | + | + | ++ | + | + |
| 22 | + | + | + | + | + |
| 23 | + | ++ | ++ | + | + |
| 24 | + | ++ | ++ | + | + |
| 25 | + | ++ | ++ | + | + |
| 26 | + | ++ | ++ | + | + |
| 27 | + | ++ | ++ | + | ++ |
| 28 | + | ++ | ++ | + | ++ |
| 29 | + | ++ | ++ | + | ++ |
| 30 | + | ++ | ++ | + | ++ |
| 31 | + | ++ | ++ | + | + |
| 32 | + | ++ | ++ | + | + |
| 33 | + | + | + | + | + |
| 34 | + | + | + | + | + |
| 35 | + | + | + | + | + |
| 36 | + | + | + | + | + |
| 37 | + | + | + | + | + |
| 38 | + | + | + | + | + |
| 39 | + | + | + | + | + |
| 40 | + | + | + | + | + |

Fig. 21

| Catalytic head SeqID | polypeptide linker SeqID | Spacer length [bp] 15 | 18 | 21 | 24 | Compact |
|---|---|---|---|---|---|---|
| 340 | 147 | ++ | ++ | +++ | +++ | ++ |
| 340 | 150 | +++ | +++ | ++ | +++ | ++ |
| 340 | 156 | ++ | +++ | ++ | +++ | ++ |
| 340 | 162 | +++ | +++ | +++ | +++ | ++ |
| 363 | 134 | ++ | ++ | ++ | ++ | |
| 363 | 152 | ++ | ++ | ++ | ++ | |
| 363 | 153 | ++ | ++ | ++ | ++ | |
| 363 | 159 | ++ | ++ | ++ | ++ | |
| 363 | 166 | ++ | ++ | ++ | ++ | |
| 349 | 134 | + | ++ | + | ++ | |
| 349 | 153 | + | ++ | ++ | ++ | |
| 349 | 154 | + | +++ | ++ | ++ | |
| 349 | 157 | + | +++ | ++ | +++ | |
| 349 | 162 | + | ++ | ++ | ++ | |
| 349 | 166 | + | +++ | ++ | +++ | |

Fig. 22

| target | pCLS12945 | pCLS12946 | pCLS12947 | pCLS12948 | pCLS12949 | pCLS12950 | pCLS12951 |
|---|---|---|---|---|---|---|---|
| RAGT2.3 | +++ | +++ | +/- | +++ | +++ | +++ | +++ |
| Ctrl neg | n.d. | n.d. | n.d. | n.d. | n.d. | n.d. | n.d. |

Fig. 25D

TALEN RAGT2.3

| | RAGT2.3 | RAGT2.3 degenerated in position N | | | RAGT2.3 degenerated in position N-1 | | |
|---|---|---|---|---|---|---|---|
| Sequence at positions N-1 and N | AT | AG | AC | AA | TT | GT | CT |
| Activity of TALEN containing 15.5 repeats | 0.98 | 0.98 | 1.00 | 1.00 | 0.99 | 0.99 | 0.97 |
| Activity of TALEN containing 13.5 repeats | 0.99 | 0.87 | 1.00 | 0.99 | 0.68 | 0.96 | 0.87 |
| Activity of TALEN containing 11.5 repeats | 0.98 | 0.52 | 0.88 | 0.82 | 0.00 | 0.83 | 0.55 |

TALEN RAGT2.4

| | RAGT2.4 | RAGT2.4 degenerated in position N | | | RAGT2.4 degenerated in position N-1 | | |
|---|---|---|---|---|---|---|---|
| Sequence at positions N-1 and N | AT | AG | AC | AA | TT | GT | CT |
| Activity of TALEN containing 15.5 repeats | 0.95 | 0.93 | 0.97 | 0.97 | 0.95 | 0.87 | 0.98 |
| Activity of TALEN containing 13.5 repeats | 0.99 | 0.96 | 1.00 | 0.99 | 0.95 | 0.94 | 0.98 |
| Activity of TALEN containing 11.5 repeats | 0.98 | 0.35 | 0.80 | 0.59 | 0.00 | 0.68 | 0.38 |
| Activity of TALEN containing 9.5 repeats | 0.99 | 0.58 | 0.92 | 0.83 | 0.42 | 0.81 | 0.62 |

Fig. 26

| Spacer (pb) | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 |
|---|---|---|---|---|---|---|---|---|---|---|---|---|---|---|---|---|---|---|---|---|---|---|---|---|---|---|
| Yeast activity WT | nd | nd | nd | nd | nd | nd | nd | nd | + | nd | + | + | + | + | + | nd | + | + | + | | ++ | + | + | + | + | + |
| Yeast activity Linker 8 | nd | nd | nd | + | ++ | +++ | ++ | ++ | +++ | ++ | ++ | ++ | ++ | ++ | ++ | +++ | ++ | ++ | ++ | ++ | + | + | + | + | + | + |
| Yeast activity Linker 27 | nd | nd | nd | +++ | ++++ | +++ | ++++ | ++++ | +++ | +++ | +++ | +++ | +++ | +++ | +++ | +++ | +++ | ++++ | +++ | +++ | ++++ | +++ | ++ | +++ | +++ | +++ |
| Yeast activity Linker 35 | nd | nd | nd | ++ | +++ | +++ | ++ | ++ | ++ | ++ | ++ | ++ | ++ | +++ | ++ | ++ | +++ | ++ | ++ | ++ | ++ | ++ | + | ++ | ++ | ++ |

Yeast activity
(arbitrary units)

| | | |
|---|---|---|
| <0.3 | nd | not determined |
| de 0,3 à 0.5 | + | low activity |
| 0.51 à 0.7 | ++ | medium activity |
| 0.71 à 0.9 | +++ | high activity |
| >0.9 | ++++ | saturating activity |

| Spacer length [bp] | Neg. Control | pCLS8674 |
|---|---|---|
| 5 | n.d. | n.d. |
| 6 | n.d. | n.d. |
| 7 | n.d. | n.d. |
| 8 | n.d. | n.d. |
| 9 | n.d. | n.d. |
| 10 | n.d. | + |
| 11 | n.d. | n.d. |
| 12 | n.d. | n.d. |
| 13 | n.d. | n.d. |
| 14 | n.d. | n.d. |
| 15 | n.d. | n.d. |
| 16 | n.d. | n.d. |
| 17 | n.d. | n.d. |
| 18 | n.d. | + |
| 19 | n.d. | + |
| 20 | n.d. | +++ |
| 21 | n.d. | +++ |
| 22 | n.d. | +++ |
| 23 | n.d. | +++ |
| 24 | n.d. | +++ |
| 25 | n.d. | +++ |
| 26 | n.d. | +++ |
| 27 | n.d. | +++ |
| 28 | n.d. | ++ |
| 29 | n.d. | n.d. |
| 30 | n.d. | n.d. |
| 31 | n.d. | + |
| 32 | n.d. | + |
| 33 | n.d. | ++ |
| 34 | n.d. | +++ |
| 35 | n.d. | +++ |

Fig. 27

| Spacer length [bp] | Neg. Control | pCLS9827 + pCLS8674 |
|---|---|---|
| 5 | n.d. | n.d. |
| 6 | n.d. | n.d. |
| 7 | n.d. | n.d. |
| 8 | n.d. | n.d. |
| 9 | n.d. | n.d. |
| 10 | n.d. | n.d. |
| 11 | n.d. | n.d. |
| 12 | n.d. | n.d |
| 13 | n.d. | n.d. |
| 14 | n.d. | n.d |
| 15 | n.d. | ++ |
| 16 | n.d. | ++ |
| 17 | n.d. | +++ |
| 18 | n.d. | +++ |
| 19 | n.d. | +++ |
| 20 | n.d. | +++ |
| 21 | n.d. | +++ |
| 22 | n.d. | +++ |
| 23 | n.d. | ++ |
| 24 | n.d. | ++ |
| 25 | n.d. | +++ |
| 26 | n.d. | +++ |
| 27 | n.d. | +++ |
| 28 | n.d. | +++ |
| 29 | n.d. | +++ |
| 30 | n.d. | +++ |
| 31 | n.d. | +++ |
| 32 | n.d. | +++ |
| 33 | n.d. | ++ |
| 34 | n.d. | ++ |
| 35 | n.d. | ++ |
| 36 | n.d. | ++ |
| 37 | n.d. | +++ |
| 38 | n.d. | +++ |
| 39 | n.d. | +++ |
| 40 | n.d. | +++ |

Fig. 28

| Name | Binding and target Sequences |
|---|---|
| Avr05 | TATATAAACCTAACCCTCTAGGTAAGAGGGTTAGGTTTATATA |
| Avr06 | TATATAAACCTAACCCTCTAAGGTAAGAGGGTTAGGTTTATATA |
| Avr07 | TATATAAACCTAACCCTCTAAGGTACAGAGGGTTAGGTTTATATA |
| Avr08 | TATATAAACCTAACCCTCTGAAGGTACAGAGGGTTAGGTTTATATA |
| Avr09 | TATATAAACCTAACCCTCTGAAGGTACCAGAGGGTTAGGTTTATATA |
| Avr10 | TATATAAACCTAACCCTCTTGAAGGTACCAGAGGGTTAGGTTTATATA |
| Avr11 | TATATAAACCTAACCCTCTTGAAGGTACCTAGAGGGTTAGGTTTATATA |
| Avr12 | TATATAAACCTAACCCTCTATGAAGGTACCTAGAGGGTTAGGTTTATATA |
| Avr13 | TATATAAACCTAACCCTCTATGAAGGTACCTTAGAGGGTTAGGTTTATATA |
| Avr14 | TATATAAACCTAACCCTCTCATGAAGGTACCTTAGAGGGTTAGGTTTATATA |
| AVR15 | TATATAAACCTAACCCTCTTAGCATGAAGGTACCAGAGGGTTAGGTTTATATA |
| Avr16 | TATATAAACCTAACCCTCTGCATGAAGGTACCTTGAGAGGGTTAGGTTTATATA |
| Avr17 | TATATAAACCTAACCCTCTGCATGAAGGTACCTTGTAGAGGGTTAGGTTTATATA |
| Avr18 | TATATAAACCTAACCCTCTAGCATGAAGGTACCTTGTAGAGGGTTAGGTTTATATA |
| Avr19 | TATATAAACCTAACCCTCTAGCATGAAGGTACCTTGTCAGAGGGTTAGGTTTATATA |
| Avr20 | TATATAAACCTAACCCTCTTAGCATGAAGGTACCTTGTCAGAGGGTTAGGTTTATATA |
| Avr21 | TATATAAACCTAACCCTCTTAGCATGAAGGTACCTTGTCGAGAGGGTTAGGTTTATATA |
| Avr22 | TATATAAACCTAACCCTCTTAGCATGAAGGTACCTTGTCGTAGAGGGTTAGGTTTATATA |
| Avr23 | TATATAAACCTAACCCTCTCTAGCATGAAGGTACCTTGTCGTAGAGGGTTAGGTTTATATA |
| Avr24 | TATATAAACCTAACCCTCTCTAGCATGAAGGTACCTTGTCGTTAGAGGGTTAGGTTTATATA |
| Avr25 | TATATAAACCTAACCCTCTACTAGCATGAAGGTACCTTGTCGTTAGAGGGTTAGGTTTATATA |
| Avr26 | TATATAAACCTAACCCTCTACTAGCATGAAGGTACCTTGTCGTTGAGAGGGTTAGGTTTATATA |
| Avr27 | TATATAAACCTAACCCTCTCACTAGCATGAAGGTACCTTGTCGTTGAGAGGGTTAGGTTTATATA |
| Avr28 | TATATAAACCTAACCCTCTCACTAGCATGAAGGTACCTTGTCGTTGAAGAGGGTTAGGTTTATATA |
| Avr29 | TATATAAACCTAACCCTCTCCACTAGCATGAAGGTACCTTGTCGTTGAAGAGGGTTAGGTTTATATA |
| Avr30 | TATATAAACCTAACCCTCTCCACTAGCATGAAGGTACCTTGTCGTTGATAGAGGGTTAGGTTTATATA |
| Avr31 | TATATAAACCTAACCCTCTACCACTAGCATGAAGGTACCTTGTCGTTGATAGAGGGTTAGGTTTATATA |
| Avr32 | TATATAAACCTAACCCTCTACCACTAGCATGAAGGTACCTTGTCGTTGATTAGAGGGTTAGGTTTATATA |
| Avr33 | TATATAAACCTAACCCTCTGACCACTAGCATGAAGGTACCTTGTCGTTGATTAGAGGGTTAGGTTTATATA |
| Avr34 | TATATAAACCTAACCCTCTGACCACTAGCATGAAGGTACCTTGTCGTTGATTCAGAGGGTTAGGTTTATATA |
| Avr35 | TATATAAACCTAACCCTCTTGACCACTAGCATGAAGGTACCTTGTCGTTGATTCAGAGGGTTAGGTTTATATA |
| Avr36 | TATATAAACCTAACCCTCTTGACCACTAGCATGAAGGTACCTTGTCGTTGATTCAAGAGGGTTAGGTTTATATA |
| Avr37 | TATATAAACCTAACCCTCTCTGACCACTAGCATGAAGGTACCTTGTCGTTGATTCAAGAGGGTTAGGTTTATATA |
| Avr38 | TATATAAACCTAACCCTCTCTGACCACTAGCATGAAGGTACCTTGTCGTTGATTCAGAGAGGGTTAGGTTTATATA |
| Avr39 | TATATAAACCTAACCCTCTTCTGACCACTAGCATGAAGGTACCTTGTCGTTGATTCAGAGAGGGTTAGGTTTATATA |
| Avr40 | TATATAAACCTAACCCTCTTCTGACCACTAGCATGAAGGTACCTTGTCGTTGATTCAGTAGAGGGTTAGGTTTATATA |

Fig. 29

Fig. 30

| Name | Binding and target Sequences |
|---|---|
| Avr15nA | TATATAAACCTAACCCTCATAGCATGAAGGTACCTGAGGGTTAGGTTTATATA |
| Avr15nC | TATATAAACCTAACCCTCCTAGCATGAAGGTACCGGAGGGTTAGGTTTATATA |
| Avr15nG | TATATAAACCTAACCCTCGTAGCATGAAGGTACCCGAGGGTTAGGTTTATATA |
| AVR15nT | TATATAAACCTAACCCTCTTAGCATGAAGGTACCAGAGGGTTAGGTTTATATA |

| Name | Binding and target Sequences |
|---|---|
| Avr40RAGT2R | TATATAAACCTAACCCTCTTCTGACCACTAGCATGAAGGTACCTTGTCGTTGATTCAGTATAAGTAACCATAAACA |
| Avr39RAGT2R | TATATAAACCTAACCCTCTTCTGACCACTAGCATGAAGGTACCTTGTCGTTGATTCAGATAAGTAACCATAAACA |
| Avr38RAGT2R | TATATAAACCTAACCCTCTCTGACCACTAGCATGAAGGTACCTTGTCGTTGATTCAGATAAGTAACCATAAACA |
| Avr37RAGT2R | TATATAAACCTAACCCTCTCTGACCACTAGCATGAAGGTACCTTGTCGTTGATTCAATAAGTAACCATAAACA |
| Avr36RAGT2R | TATATAAACCTAACCCTCTTGACCACTAGCATGAAGGTACCTTGTCGTTGATTCAATAAGTAACCATAAACA |
| Avr35RAGT2R | TATATAAACCTAACCCTCTTGACCACTAGCATGAAGGTACCTTGTCGTTGATTCATAAGTAACCATAAACA |
| Avr34RAGT2R | TATATAAACCTAACCCTCTGACCACTAGCATGAAGGTACCTTGTCGTTGATTCATAAGTAACCATAAACA |
| Avr33RAGT2R | TATATAAACCTAACCCTCTGACCACTAGCATGAAGGTACCTTGTCGTTGATTATAAGTAACCATAAACA |
| Avr32RAGT2R | TATATAAACCTAACCCTCTACCACTAGCATGAAGGTACCTTGTCGTTGATTATAAGTAACCATAAACA |
| Avr31RAGT2R | TATATAAACCTAACCCTCTACCACTAGCATGAAGGTACCTTGTCGTTGATATAAGTAACCATAAACA |
| Avr30RAGT2R | TATATAAACCTAACCCTCTCCACTAGCATGAAGGTACCTTGTCGTTGATATAAGTAACCATAAACA |
| AVR29RAGT2R | TATATAAACCTAACCCTCTCCACTAGCATGAAGGTACCTTGTCGTTGAATAAGTAACCATAAACA |
| Avr28RAGT2R | TATATAAACCTAACCCTCTCACTAGCATGAAGGTACCTTGTCGTTGAATAAGTAACCATAAACA |
| Avr27RAGT2R | TATATAAACCTAACCCTCTCACTAGCATGAAGGTACCTTGTCGTTGATAAGTAACCATAAACA |
| Avr26RAGT2R | TATATAAACCTAACCCTCTACTAGCATGAAGGTACCTTGTCGTTGATAAGTAACCATAAACA |
| Avr25RAGT2R | TATATAAACCTAACCCTCTACTAGCATGAAGGTACCTTGTCGTTATAAGTAACCATAAACA |
| Avr24RAGT2R | TATATAAACCTAACCCTCTCTAGCATGAAGGTACCTTGTCGTTATAAGTAACCATAAACA |
| Avr23RAGT2R | TATATAAACCTAACCCTCTCTAGCATGAAGGTACCTTGTCGTATAAGTAACCATAAACA |
| Avr22RAGT2R | TATATAAACCTAACCCTCTTAGCATGAAGGTACCTTGTCGTATAAGTAACCATAAACA |
| Avr21RAGT2R | TATATAAACCTAACCCTCTTAGCATGAAGGTACCTTGTCGATAAGTAACCATAAACA |
| Avr20RAGT2R | TATATAAACCTAACCCTCTTAGCATGAAGGTACCTTGTCATAAGTAACCATAAACA |
| Avr19RAGT2R | TATATAAACCTAACCCTCTAGCATGAAGGTACCTTGTCATAAGTAACCATAAACA |
| Avr18RAGT2R | TATATAAACCTAACCCTCTAGCATGAAGGTACCTTGTATAAGTAACCATAAACA |
| Avr17RAGT2R | TATATAAACCTAACCCTCTGCATGAAGGTACCTTGTATAAGTAACCATAAACA |
| Avr16RAGT2R | TATATAAACCTAACCCTCTGCATGAAGGTACCTTGATAAGTAACCATAAACA |
| Avr15RAGT2R | TATATAAACCTAACCCTCTTAGCATGAAGGTACCATAAGTAACCATAAACA |
| Avr14RAGT2R | TATATAAACCTAACCCTCTCATGAAGGTACCTTATAAGTAACCATAAACA |
| Avr13RAGT2R | TATATAAACCTAACCCTCTATGAAGGTACCTTATAAGTAACCATAAACA |
| Avr12RAGT2R | TATATAAACCTAACCCTCTATGAAGGTACCTATAAGTAACCATAAACA |
| Avr11RAGT2R | TATATAAACCTAACCCTCTTGAAGGTACCTATAAGTAACCATAAACA |
| Avr10RAGT2R | TATATAAACCTAACCCTCTTGAAGGTACCATAAGTAACCATAAACA |
| Avr09RAGT2R | TATATAAACCTAACCCTCTGAAGGTACCATAAGTAACCATAAACA |
| Avr08RAGT2R | TATATAAACCTAACCCTCTGAAGGTACATAAGTAACCATAAACA |
| Avr07RAGT2R | TATATAAACCTAACCCTCTAAGGTACATAAGTAACCATAAACA |
| Avr06RAGT2R | TATATAAACCTAACCCTCTAAGGTAATAAGTAACCATAAACA |
| Avr05RAGT2R | TATATAAACCTAACCCTCTAGGTAATAAGTAACCATAAACA |

Fig. 31

| | C terminal scaffold | | | | |
|---|---|---|---|---|---|
| Name | wt | C0 | C11 | C40 | Spacer length |
| CAPT2.3 | n.d. | n.d. | n.d. | n.d. | 15 |
| DMDT1.3 | n.d. | ++ | +++ | +++ | 15 |
| RAGT1.3 | n.d. | n.d. | + | +++ | 15 |
| CAPT2.4 | n.d. | +++ | +++ | +++ | 15 |
| DMDT1.4 | n.d. | n.d. | n.d. | ++ | 15 |
| SH6T2.4 | + | + | +++ | +++ | 15 |
| CAPT1.4 | + | +++ | +++ | n.a. | 15 |
| NPTIIT5. | + | ++ | +++ | +++ | 21 |
| ILRGT2.3 | + | ++ | ++ | +++ | 15 |
| HBBT1.4 | + | +++ | +++ | +++ | 15 |
| CAPT1.3 | + | + | +++ | +++ | 15 |
| HBBT1.3 | + | ++ | +++ | +++ | 15 |
| SH6T1.4 | + | ++ | +++ | +++ | 15 |
| DMDT2.3 | ++ | +++ | +++ | +++ | 15 |
| SADET3.3 | ++ | n.a. | ++ | +++ | 24 |
| NPTIIT6. | ++ | +++ | +++ | +++ | 24 |
| NPTIIT5. | ++ | +++ | +++ | +++ | 21 |
| SH6T1.3 | ++ | +++ | +++ | +++ | 15 |
| DMDT2.4 | ++ | + | ++ | +++ | 15 |
| ILRGT2.4 | ++ | ++ | ++ | +++ | 15 |
| RAGT2.4 | +++ | +++ | +++ | +++ | 15 |
| RAGT2.3 | +++ | ++ | +++ | +++ | 15 |
| NPTIIT2. | +++ | +++ | ++ | +++ | 15 |
| RAGT1.4 | +++ | +++ | n.a. | +++ | 15 |
| NPTIIT2. | +++ | +++ | +++ | +++ | 15 |
| NPTIIT6. | +++ | +++ | +++ | +++ | 24 |
| SADET3.4 | n.a. | +++ | +++ | +++ | 24 |

Fig. 32

| Target name | Binding and Target Sequences |
| --- | --- |
| CAPT2.3 | TAAAAACAATAATATTTTTTAAGTAAATAAAGAAATATTATTGTTTTTA |
| DMDT1.3 | TTTAAATAACATGTCTTATTATCTCTGTTAACAAGACATGTTATTTAAA |
| RAGT1.3 | TGAATAAATAATTGAATGTATTTATTTTTATTATTCAATTATTTATTCA |
| CAPT2.4 | TGGCCACGGCCTGGTTTTTTAAGTAAATAAAGAAACCAGGCCGTGGCCA |
| DMDT1.4 | TTAAAAAGCTGTACATTATTATCTCTGTTAACAATGTACAGCTTTTTAA |
| SH6T2.4 | TGCTGGGGGCAATTAATTTTGCTTCCCACAGCATTAATTGCCCCCAGCA |
| CAPT1.4 | TCTGTGGGCTCGGGTCTCACAGCCACGATCTTAGACCCGAGCCCACAGA |
| NPTIIT5.3 | TCCTTGCGCAGCTGTGCTCGACGTTGTCACTGAAGCGGGCACAGCTGCGCAAGGA |
| ILRGT2.3 | TGGGTTAGCGTGTTGTTAGAGTAGGGGAGTGGAACAACACGCTAACCCA |
| HBBT1.4 | TGCACCATGGTGTCTGTCACTAGCAACCTCAAACAGACACCATGGTGCA |
| CAPT1.3 | TCCGGGAACCCAGAGCTCACAGCCACGATCTTAGCTCTGGGTTCCCGGA |
| HBBT1.3 | TCTGACACAACTGTGTTCACTAGCAACCTCAAAACACAGTTGTGTCAGA |
| SH6T1.4 | TGGTATTGGACAGTACTTAATTGCCCCCAGCAAGTACTGTCCAATACCA |
| DMDT2.3 | TGTATTCCTTTATGGATCAGTTAACATTATAAATCCATAAAGGAATACA |
| SADET3.3 | TCTAGATTACATTTTCTCACTGTCCCAATGTGCTTGATATGAGAAAATGTAATCTAGA |
| NPTIIT6.3 | TGAAGCGGGAAGGGACTGGCTGCTATTGGGCGAAGTGCCGGAGTCCCTTCCCGCTTCA |
| NPTIIT5.4 | TAGCAGCCAGTCCCTTCTCGACGTTGTCACTGAAGCGGGAAGGGACTGGCTGCTA |
| SH6T1.3 | TTTGCTTCCCACAGCATTAATTGCCCCCAGCAATGCTGTGGGAAGCAAA |
| DMDT2.4 | TGAGCTAAAGTTATCATCAGTTAACATTATAAATGATAACTTTAGCTCA |
| ILRGT2.4 | TCAGCCTCCTTCTCAATAGAGTAGGGGAGTGGATTGAGAAGGAGGCTGA |
| RAGT2.4 | TGTTTATGGTTACTTATATGTGTGTAACAGGTATAAGTAACCATAAACA |
| RAGT2.3 | TATATTTAAGCACTTATATGTGTGTAACAGGTATAAGTGCTTAAATATA |
| NPTIIT2.3 | TGTCAAGACCGACCTGTCCGGTGCCCTGAATGACAGGTCGGTCTTGACA |
| RAGT1.4 | TGATGTATCTTATAAATGTATTTATTTTTATTATTTATAAGATACATCA |
| NPTIIT2.4 | TGCCTCGTCCTGCAGTTCCGGTGCCCTGAATGAACTGCAGGACGAGGCA |
| NPTIIT6.4 | TGACAGGAGATCCTGCCGGCTGCTATTGGGCGAAGTGCCGGGGCAGGATCTCCTGTCA |
| SADET3.4 | TTATGGTGGTGTCAGTTCACTGTCCCAATGTGCTTGATATGAACTGACACCACCATAA |

Fig. 33

| Target name | Nucleic acid Target Sequence |
|---|---|
| Avr05 | TATATAAACCTAACCCTCTAGGTAAGAGGGTTAGGTTTATATA |
| Avr06 | TATATAAACCTAACCCTCTAAGGTAAGAGGGTTAGGTTTATATA |
| Avr07 | TATATAAACCTAACCCTCTAAGGTACAGAGGGTTAGGTTTATATA |
| Avr08 | TATATAAACCTAACCCTCTGAAGGTACAGAGGGTTAGGTTTATATA |
| Avr09 | TATATAAACCTAACCCTCTGAAGGTACCAGAGGGTTAGGTTTATATA |
| Avr10 | TATATAAACCTAACCCTCTTGAAGGTACCAGAGGGTTAGGTTTATATA |
| Avr11 | TATATAAACCTAACCCTCTTGAAGGTACCTAGAGGGTTAGGTTTATATA |
| Avr12 | TATATAAACCTAACCCTCTATGAAGGTACCTAGAGGGTTAGGTTTATATA |
| Avr13 | TATATAAACCTAACCCTCTATGAAGGTACCTTAGAGGGTTAGGTTTATATA |
| Avr14 | TATATAAACCTAACCCTCTCATGAAGGTACCTTAGAGGGTTAGGTTTATATA |
| AVR15 | TATATAAACCTAACCCTCTTAGCATGAAGGTACCAGAGGGTTAGGTTTATATA |
| Avr16 | TATATAAACCTAACCCTCTGCATGAAGGTACCTTGAGAGGGTTAGGTTTATATA |
| Avr17 | TATATAAACCTAACCCTCTGCATGAAGGTACCTTGTAGAGGGTTAGGTTTATATA |
| Avr18 | TATATAAACCTAACCCTCTAGCATGAAGGTACCTTGTAGAGGGTTAGGTTTATATA |
| Avr19 | TATATAAACCTAACCCTCTAGCATGAAGGTACCTTGTCAGAGGGTTAGGTTTATATA |
| Avr20 | TATATAAACCTAACCCTCTTAGCATGAAGGTACCTTGTCAGAGGGTTAGGTTTATATA |
| Avr21 | TATATAAACCTAACCCTCTTAGCATGAAGGTACCTTGTCGAGAGGGTTAGGTTTATATA |
| Avr22 | TATATAAACCTAACCCTCTTAGCATGAAGGTACCTTGTCGTAGAGGGTTAGGTTTATATA |
| Avr23 | TATATAAACCTAACCCTCTCTAGCATGAAGGTACCTTGTCGTAGAGGGTTAGGTTTATATA |
| Avr24 | TATATAAACCTAACCCTCTCTAGCATGAAGGTACCTTGTCGTTAGAGGGTTAGGTTTATATA |
| Avr25 | TATATAAACCTAACCCTCTACTAGCATGAAGGTACCTTGTCGTTAGAGGGTTAGGTTTATATA |
| Avr26 | TATATAAACCTAACCCTCTACTAGCATGAAGGTACCTTGTCGTTGAGAGGGTTAGGTTTATATA |
| Avr27 | TATATAAACCTAACCCTCTCACTAGCATGAAGGTACCTTGTCGTTGAGAGGGTTAGGTTTATATA |
| Avr28 | TATATAAACCTAACCCTCTCACTAGCATGAAGGTACCTTGTCGTTGAAGAGGGTTAGGTTTATATA |
| Avr29 | TATATAAACCTAACCCTCTCCACTAGCATGAAGGTACCTTGTCGTTGAAGAGGGTTAGGTTTATATA |
| Avr30 | TATATAAACCTAACCCTCTCCACTAGCATGAAGGTACCTTGTCGTTGATAGAGGGTTAGGTTTATATA |
| Avr31 | TATATAAACCTAACCCTCTACCACTAGCATGAAGGTACCTTGTCGTTGATAGAGGGTTAGGTTTATATA |
| Avr32 | TATATAAACCTAACCCTCTACCACTAGCATGAAGGTACCTTGTCGTTGATTAGAGGGTTAGGTTTATATA |
| Avr33 | TATATAAACCTAACCCTCTGACCACTAGCATGAAGGTACCTTGTCGTTGATTAGAGGGTTAGGTTTATATA |
| Avr34 | TATATAAACCTAACCCTCTGACCACTAGCATGAAGGTACCTTGTCGTTGATTCAGAGGGTTAGGTTTATATA |
| Avr35 | TATATAAACCTAACCCTCTTGACCACTAGCATGAAGGTACCTTGTCGTTGATTCAGAGGGTTAGGTTTATATA |
| Avr36 | TATATAAACCTAACCCTCTTGACCACTAGCATGAAGGTACCTTGTCGTTGATTCAAGAGGGTTAGGTTTATATA |
| Avr37 | TATATAAACCTAACCCTCTCTGACCACTAGCATGAAGGTACCTTGTCGTTGATTCAAGAGGGTTAGGTTTATATA |
| Avr38 | TATATAAACCTAACCCTCTCTGACCACTAGCATGAAGGTACCTTGTCGTTGATTCAGAGAGGGTTAGGTTTATATA |
| Avr39 | TATATAAACCTAACCCTCTTCTGACCACTAGCATGAAGGTACCTTGTCGTTGATTCAGAGAGGGTTAGGTTTATATA |
| Avr40 | TATATAAACCTAACCCTCTTCTGACCACTAGCATGAAGGTACCTTGTCGTTGATTCAGTAGAGGGTTAGGTTTATATA |
| | |
| compact | TATATAAACCTAACCCTCTTAGCATGAAGGTACCTTGTCGATGGTGTACAGTAGGGGGAGATGCA |
| | |
| neg. Ctrl. | TTGTTCTCAGGTACCTCAGCCAGA |

Fig. 34

| Target name | Nucleic acid Target Sequence |
|---|---|
| NfusAvr05 | AGAGGGTTAGGTTTATATAaggtaTATATAAACCTAACCCTCT |
| NfusAvr06 | AGAGGGTTAGGTTTATATAaaggtaTATATAAACCTAACCCTCT |
| NfusAvr07 | AGAGGGTTAGGTTTATATAaaggtacTATATAAACCTAACCCTCT |
| NfusAvr08 | AGAGGGTTAGGTTTATATAgaaggtacTATATAAACCTAACCCTCT |
| NfusAvr09 | AGAGGGTTAGGTTTATATAgaaggtaccTATATAAACCTAACCCTCT |
| NfusAvr10 | AGAGGGTTAGGTTTATATAtgaaggtaccTATATAAACCTAACCCTCT |
| NfusAvr11 | AGAGGGTTAGGTTTATATAtgaaggtacctTATATAAACCTAACCCTCT |
| NfusAvr12 | AGAGGGTTAGGTTTATATAatgaaggtacctTATATAAACCTAACCCTCT |
| NfusAvr13 | AGAGGGTTAGGTTTATATAatgaaggtaccttTATATAAACCTAACCCTCT |
| NfusAvr14 | AGAGGGTTAGGTTTATATAcatgaaggtaccttTATATAAACCTAACCCTCT |
| NfusAvr15 | AGAGGGTTAGGTTTATATAcatgaaggtaccttgTATATAAACCTAACCCTCT |
| NfusAvr16 | AGAGGGTTAGGTTTATATAgcatgaaggtaccttgTATATAAACCTAACCCTCT |
| NfusAvr17 | AGAGGGTTAGGTTTATATAgcatgaaggtaccttgtTATATAAACCTAACCCTCT |
| NfusAvr18 | AGAGGGTTAGGTTTATATAagcatgaaggtaccttgtTATATAAACCTAACCCTCT |
| NfusAvr19 | AGAGGGTTAGGTTTATATAagcatgaaggtaccttgtcTATATAAACCTAACCCTCT |
| NfusAvr20 | AGAGGGTTAGGTTTATATAtagcatgaaggtaccttgtcTATATAAACCTAACCCTCT |
| NfusAvr21 | AGAGGGTTAGGTTTATATAtagcatgaaggtaccttgtcgTATATAAACCTAACCCTCT |
| NfusAvr22 | AGAGGGTTAGGTTTATATAtagcatgaaggtaccttgtcgtTATATAAACCTAACCCTCT |
| NfusAvr23 | AGAGGGTTAGGTTTATATActagcatgaaggtaccttgtcgtTATATAAACCTAACCCTCT |
| NfusAvr24 | AGAGGGTTAGGTTTATATActagcatgaaggtaccttgtcgttTATATAAACCTAACCCTCT |
| NfusAvr25 | AGAGGGTTAGGTTTATATAactagcatgaaggtaccttgtcgttTATATAAACCTAACCCTCT |
| NfusAvr26 | AGAGGGTTAGGTTTATATAactagcatgaaggtaccttgtcgttgTATATAAACCTAACCCTCT |
| NfusAvr27 | AGAGGGTTAGGTTTATATAcactagcatgaaggtaccttgtcgttgTATATAAACCTAACCCTCT |
| NfusAvr28 | AGAGGGTTAGGTTTATATAcactagcatgaaggtaccttgtcgttgaTATATAAACCTAACCCTCT |
| NfusAvr29 | AGAGGGTTAGGTTTATATAccactagcatgaaggtaccttgtcgttgaTATATAAACCTAACCCTCT |
| NfusAvr30 | AGAGGGTTAGGTTTATATAccactagcatgaaggtaccttgtcgttgatTATATAAACCTAACCCTCT |
| NfusAvr31 | AGAGGGTTAGGTTTATATAaccactagcatgaaggtaccttgtcgttgatTATATAAACCTAACCCTCT |
| NfusAvr32 | AGAGGGTTAGGTTTATATAaccactagcatgaaggtaccttgtcgttgattTATATAAACCTAACCCTCT |
| NfusAvr33 | AGAGGGTTAGGTTTATATAgaccactagcatgaaggtaccttgtcgttgattTATATAAACCTAACCCTCT |
| NfusAvr34 | AGAGGGTTAGGTTTATATAgaccactagcatgaaggtaccttgtcgttgattcTATATAAACCTAACCCTCT |
| NfusAvr35 | AGAGGGTTAGGTTTATATAtgaccactagcatgaaggtaccttgtcgttgattcTATATAAACCTAACCCTCT |

Fig. 35

| Target name | Nucleic acid Target Sequence |
|---|---|
| C_N_RAGAvr05 | TGTTTATGGTTACTTATaggtaTATATAAACCTAACCCTCT |
| C_N_RAGAvr06 | TGTTTATGGTTACTTATaaggtaTATATAAACCTAACCCTCT |
| C_N_RAGAvr07 | TGTTTATGGTTACTTATaaggtacTATATAAACCTAACCCTCT |
| C_N_RAGAvr08 | TGTTTATGGTTACTTATgaaggtacTATATAAACCTAACCCTCT |
| C_N_RAGAvr09 | TGTTTATGGTTACTTATgaaggtaccTATATAAACCTAACCCTCT |
| C_N_RAGAvr10 | TGTTTATGGTTACTTATtgaaggtaccTATATAAACCTAACCCTCT |
| C_N_RAGAvr11 | TGTTTATGGTTACTTATtgaaggtacctTATATAAACCTAACCCTCT |
| C_N_RAGAvr12 | TGTTTATGGTTACTTATatgaaggtacctTATATAAACCTAACCCTCT |
| C_N_RAGAvr13 | TGTTTATGGTTACTTATatgaaggtaccttTATATAAACCTAACCCTCT |
| C_N_RAGAvr14 | TGTTTATGGTTACTTATcatgaaggtaccttTATATAAACCTAACCCTCT |
| C_N_RAGAvr15 | TGTTTATGGTTACTTATtagcatgaaggtaccTATATAAACCTAACCCTCT |
| C_N_RAGAvr16 | TGTTTATGGTTACTTATgcatgaaggtaccttgTATATAAACCTAACCCTCT |
| C_N_RAGAvr17 | TGTTTATGGTTACTTATgcatgaaggtaccttgtTATATAAACCTAACCCTCT |
| C_N_RAGAvr18 | TGTTTATGGTTACTTATagcatgaaggtaccttgtTATATAAACCTAACCCTCT |
| C_N_RAGAvr19 | TGTTTATGGTTACTTATagcatgaaggtaccttgtcTATATAAACCTAACCCTCT |
| C_N_RAGAvr20 | TGTTTATGGTTACTTATtagcatgaaggtaccttgtcTATATAAACCTAACCCTCT |
| C_N_RAGAvr21 | TGTTTATGGTTACTTATtagcatgaaggtaccttgtcgTATATAAACCTAACCCTCT |
| C_N_RAGAvr22 | TGTTTATGGTTACTTATtagcatgaaggtaccttgtcgtTATATAAACCTAACCCTCT |
| C_N_RAGAvr23 | TGTTTATGGTTACTTATctagcatgaaggtaccttgtcgtTATATAAACCTAACCCTCT |
| C_N_RAGAvr24 | TGTTTATGGTTACTTATctagcatgaaggtaccttgtcgttTATATAAACCTAACCCTCT |
| C_N_RAGAvr25 | TGTTTATGGTTACTTATactagcatgaaggtaccttgtcgttTATATAAACCTAACCCTCT |
| C_N_RAGAvr26 | TGTTTATGGTTACTTATactagcatgaaggtaccttgtcgttgTATATAAACCTAACCCTCT |
| C_N_RAGAvr27 | TGTTTATGGTTACTTATcactagcatgaaggtaccttgtcgttgTATATAAACCTAACCCTCT |
| C_N_RAGAvr28 | TGTTTATGGTTACTTATcactagcatgaaggtaccttgtcgttgaTATATAAACCTAACCCTCT |
| C_N_RAGAvr29 | TGTTTATGGTTACTTATccactagcatgaaggtaccttgtcgttgaTATATAAACCTAACCCTCT |
| C_N_RAGAvr30 | TGTTTATGGTTACTTATccactagcatgaaggtaccttgtcgttgatTATATAAACCTAACCCTCT |
| C_N_RAGAvr31 | TGTTTATGGTTACTTATaccactagcatgaaggtaccttgtcgttgatTATATAAACCTAACCCTCT |
| C_N_RAGAvr32 | TGTTTATGGTTACTTATaccactagcatgaaggtaccttgtcgttgattTATATAAACCTAACCCTCT |
| C_N_RAGAvr33 | TGTTTATGGTTACTTATgaccactagcatgaaggtaccttgtcgttgattTATATAAACCTAACCCTCT |
| C_N_RAGAvr34 | TGTTTATGGTTACTTATgaccactagcatgaaggtaccttgtcgttgattcTATATAAACCTAACCCTCT |
| C_N_RAGAvr35 | TGTTTATGGTTACTTATtgaccactagcatgaaggtaccttgtcgttgattcTATATAAACCTAACCCTCT |
| C_N_RAGAvr36 | TGTTTATGGTTACTTATtgaccactagcatgaaggtaccttgtcgttgattcaTATATAAACCTAACCCTCT |
| C_N_RAGAvr37 | TGTTTATGGTTACTTATctgaccactagcatgaaggtaccttgtcgttgattcaTATATAAACCTAACCCTCT |
| C_N_RAGAvr38 | TGTTTATGGTTACTTATctgaccactagcatgaaggtaccttgtcgttgattcagTATATAAACCTAACCCTCT |
| C_N_RAGAvr39 | TGTTTATGGTTACTTATtctgaccactagcatgaaggtaccttgtcgttgattcagTATATAAACCTAACCCTCT |
| C_N_RAGAvr40 | TGTTTATGGTTACTTATtctgaccactagcatgaaggtaccttgtcgttgattcagtTATATAAACCTAACCCTCT |

Fig. 36

TALE-PROTEIN SCAFFOLDS AND USES THEREOF

SEQUENCE LISTING

The instant application contains a Sequence Listing which has been submitted electronically in ASCII format and is hereby incorporated by reference in its entirety. Said ASCII copy, created on Jan. 2, 2019, is named 14009509_seq and is 2.14 megabytes in size.

FIELD OF THE INVENTION

The present invention relates to new Transcription Activator-Like Effector proteins and more particularly new Transcription Activator-Like Effector Nucleases (TALENs) that can efficiently target and process nucleic acids. The present invention also concerns methods to use these new Transcription Activator-Like Effector proteins. The present invention also relates to vectors, compositions and kits in which Transcription Activator-Like Effector proteins of the present invention are used.

BACKGROUND OF THE INVENTION

Transcription activator-like effectors (TAL effectors) proteins have emerged recently as an alternative tool for genome modifications. Despite the fact than meganucleases or Zinc Finger proteins have proven to be efficient tools for precise manipulation of the genome, one of the major limitations of these technologies is the difficulty and cost involve in their engineering. The promises of the TAL effectors scaffolds reside in the simplicity of the interactions existing between the protein and its DNA binding site that makes this technology within the reach of any laboratory.

Natural TAL effectors are produced by phytopathogenic bacteria and function upon infection as transcription activators of plant genes [for review see (Bogdanove, Schornack et al. 2010; Christian, Cermak et al. 2010) ]. Since the isolation of the first TAL effectors gene (Bonar, Stall et al. 1989), the presence of repetitive motifs nearly identical within the central domain has been questioned. Today this central domain has been shown to be responsible for DNA recognition through a new type of DNA-binding domain (Boch, Scholze et al. 2009; Moscou and Bogdanove 2009). Each repeat is made usually of 33 or 34 amino acids and mediates the recognition of 1 nucleotide of the DNA target through 2 critical amino acids located at positions 12 and 13 in each repeat. These 2 hypervariable positions are referred as "repeat-variable di-residue (RVD). More than 15 differents RVDs have been described today, however, HD, NG, NI, NN and NK are the most prevalent RVDs associated preferentially with the nucleotides C, T, A, G/A, and G respectively. Thus, the discovery of this simple code, where one RVD preferentially bind to one nucleotide and does not seem to be influenced by its neighboring repeat, allowed the a priori design of new sequential association of RVDs with novel DNA binding specificity (Boch, Scholze et al. 2009). This finding triggered off the interest of the scientific community for the TAL-effectors proteins as a potential tool for genome engineering, and it didn't take long before the first TAL Nuclease (TALEN) consisting of natural or custom TAL effectors fused to the nuclease catalytic domain of the Fok1 nuclease were made (Christian, Cermak et al. 2010; Miller, Tan et al. 2010; Cermak, Doyle et al. 2011; Li, Huang et al. 2011; Li, Huang et al. 2011)

Shortly after the first demonstrations that targets of new TAL effectors could be predicted and custom TALEs could function as transcription factor (Romer, Recht et al. 2009) (Boch, Scholze et al. 2009; Moscou and Bogdanove 2009), the first study on custom-TALENs as reagent for genome engineering was reported. (Christian, Cermak et al. 2010). Using the molecular strategy used for ZFNs, i.e. a pair of TAL effectors fused to Fok1 nuclease catalytic domains, binding respectively two nearby DNA sequences in opposite direction, the authors showed that (i) specific custom-made endonucleases could be produced and, (ii) using extra chromosomal assays, that they were efficient to induce homologous recombination between two inverted repeats. The size of the spacer length between the 2 DNA binding domains was also partly addressed in this pioneer work although one later study (Miller, Tan et al. 2010) brought better light on that issue. By analysis of 20 previously reported TAL effectors (Moscou and Bogdanove 2009) and their own data, the same team also published a guideline to help the design of de novo TALEN (Cermak, Doyle et al. 2011): the targeted sequence must start by a T, then T and A should be disfavored at position 1 and 2 respectively. They found also a strong bias towards the RVD-NG at the last position of the repeat arrays. Finally, the target DNA should have a low G content (9±8%). The robustness of these rules is not yet established. So far, the most established limitations when one want to design a TALEN against a chosen sequence is the presence of a T at the beginning of each target DNA sequence. Actually this essential T is not imposed by a specific RVD as it interacts directly with the N-terminal domain of the protein, and thus is not governed by the so called RVD code.

ZFN are classically heterodimeric proteins that bind two DNA sequences separated by 6bp. The TALEN described so far were all designed following the same architecture i.e. TALEN acts as heterodimers proteins in which the nuclease catalytic domain such Fok1 is fused to the TALE C-terminal region. Thus, the optimal length of the DNA sequence separating the two binding domains had to be determined. While ZFNs DNA targets contain almost exclusively 6bp intervening sequences, TALEN appears to tolerate a much more wide range of DNA length and as expected, appears to be dependent on the TALE scaffold used. As mentioned above, natural TAL effectors proteins are made of RVDs arrays that confer specificity, flanked by an N-terminal peptide sequence involves in Cellular trafficking and a C-terminal domain that contains the trans-activator domain and nuclear localization sequences (NLS). Early works on TALE have already demonstrated that 152 amino acids could be deleted from the N-terminal domain without affecting the protein activity (Szurek, Rossier et al. 2002; Gurlebeck, Szurek et al. 2005). Obviously, for nuclease purposes, the trans-activation domain appears superfluous. The early study performed by Christian et al (Christian, Cermak et al. 2010) used two BamHI restriction sites located in the N- and C-terminal domains to truncate the protein. Without further investigation the authors were able to show that this design was effective to elicit active TALEN. Furthermore using this scaffold, a spacer of 15 nucleotides was optimum, although 18 or 24 bp could be also possible. In yeast assay, this design could achieve similar activity than activity observed with ZFN. The best analysis available today on scaffold optimization was performed by Miller et al. (Miller, Tan et al. 2010) that used TAL effectors lacking its first 152 amino acids and tested a combination a C-terminal truncations of TALE on homodimeric TALEN activity against targets bearing various lengths of spacer (from 2 to 24 bps). A spacer length below 10 nucleotides did not allowed efficient cleavage in vitro as did the C-terminal truncation bearing the 95 first amino acids of the C-terminal domain. Moreover, TALEN bearing the 28 first residus of the C-terminal domain showed nuclease activity in vitro when tested on target comprising spacer from 10 to 24 bps, with a maximal activity for spacer of 12-13bps. Sequences narrower than 8bp did not allow significant cleavage activity. Even though some guidance's were described (Cermak, Doyle et al. 2011) to help designing active TALEN, too few data are available today to confirm their benefits.

The inventors have developed a new type of TAL effector proteins and particularly a new type of TALEN that can be engineered to specifically recognize and process target nucleic acid efficiently, overpassing the actual limitations.

BRIEF SUMMARY OF THE INVENTION

In a general aspect, the present invention relates to new Transcription Activator-Like Effector proteins and more particularly new Transcription Activator-Like Effector Nucleases (TALENs) that can efficiently target and process nucleic acids. The present invention also concerns methods to use these new Transcription Activator-Like Effector proteins for various applications. In another aspect, the present invention also concerns the creation of functional single-polypeptide fusion proteins, i.e chimeric proteins derived from a Transcription Activator-Like Effector for simple and efficient vectorization. In another aspect, the present invention also relates to vectors, compositions and kits in which chimeric proteins of the present invention derived of Transcription Activator-Like Effector are used.

BRIEF DESCRIPTION OF THE FIGURES AND TABLES

In addition to the preceding features, the invention further comprises other features which will emerge from the description which follows, as well as to the appended drawings. A more complete appreciation of the invention and many of the attendant advantages thereof will be readily obtained as the same becomes better understood by reference to the following Figures in conjunction with the detailed description below.

FIG. 1: General description of a chimeric protein according to the present invention.

Figure 2:
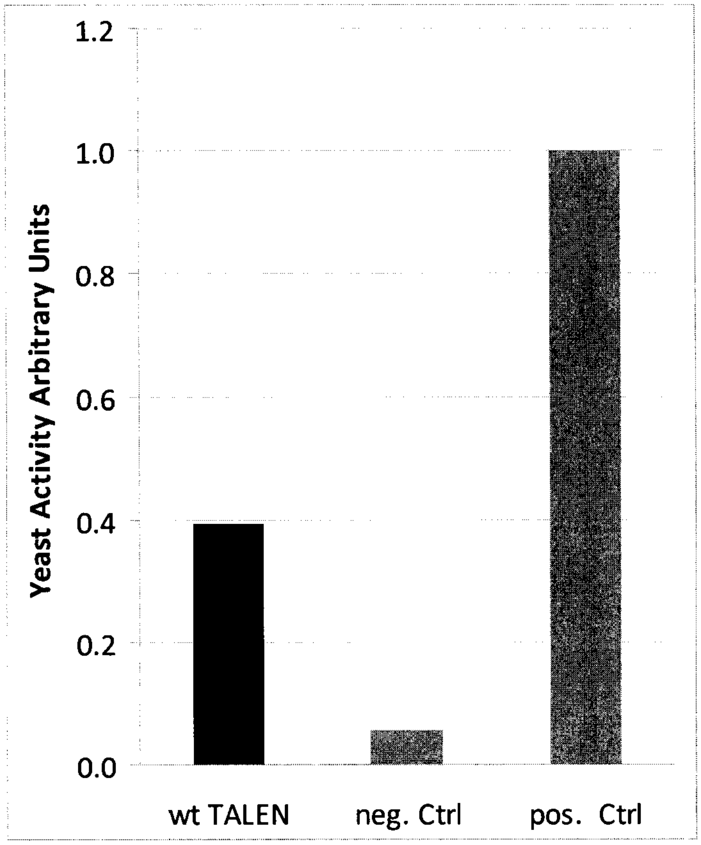

FIG. 2: Activity of AvrBs3-derived TALEN in yeast (30° C.); AvrBs3-derived TALEN is represented by a black bar and negative control (empty vector) and positive control (I-SceI meganuclease) are represented by grey bars. Activities are normalized to the positive control.

Figure 3:
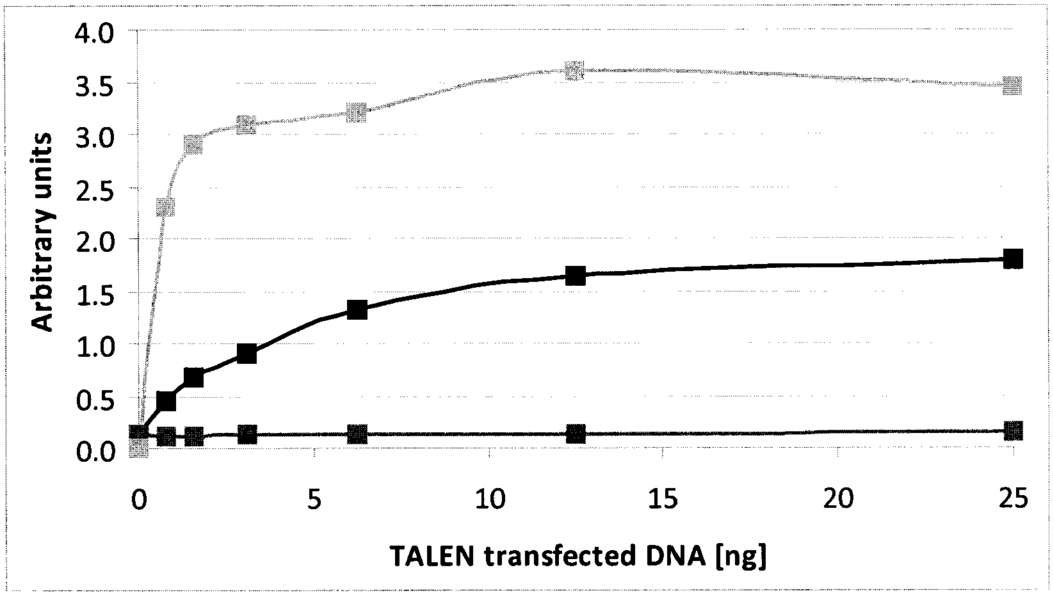
Figure 4:
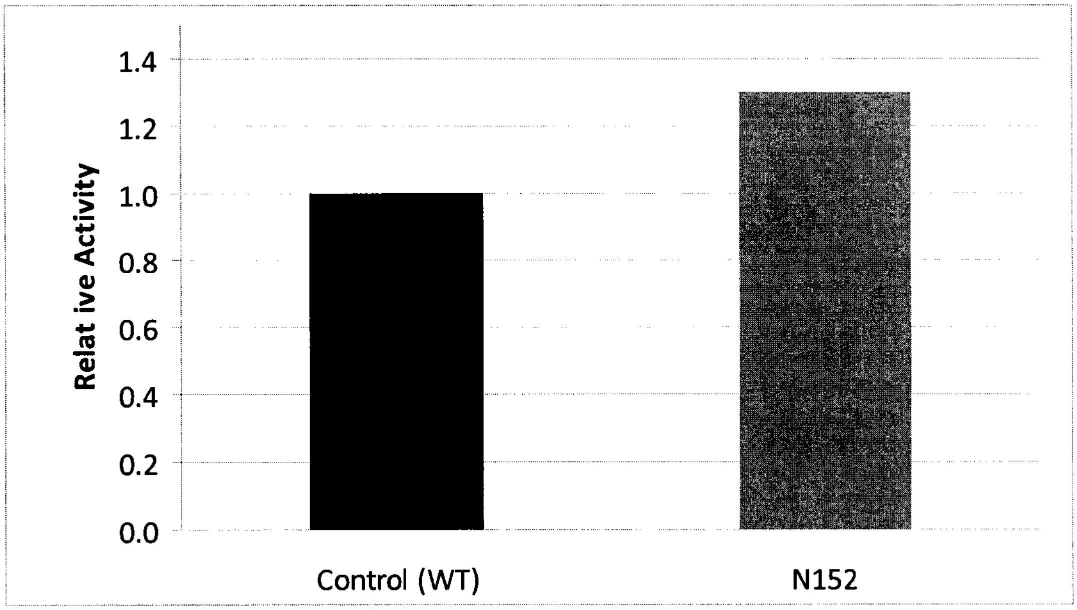

FIG. 3: Activty of AVRBs3-derived TALEN in mammalian cells (Extrachromosomic assay in CHO-KI); AvrBs3-derived TALEN is represented by a black curve, negative control (empty vector) by a dark grey curve and positive control (I-SceI meganuclease) by a light grey curve FIG. 4: Activty of N152 AvrBs3-derived TALEN in yeast (30° C.); truncated variants is represented by a grey bars and AvrBs3-derived TALEN (control wt) is represented by a black bar. Activities are normalized to the AvrBs3-derived TALEN (Control wt) (SEQ ID NO: 5) activity on its 15 bp target (Avr15) (SEQ ID NO: 6).

Figure 5:
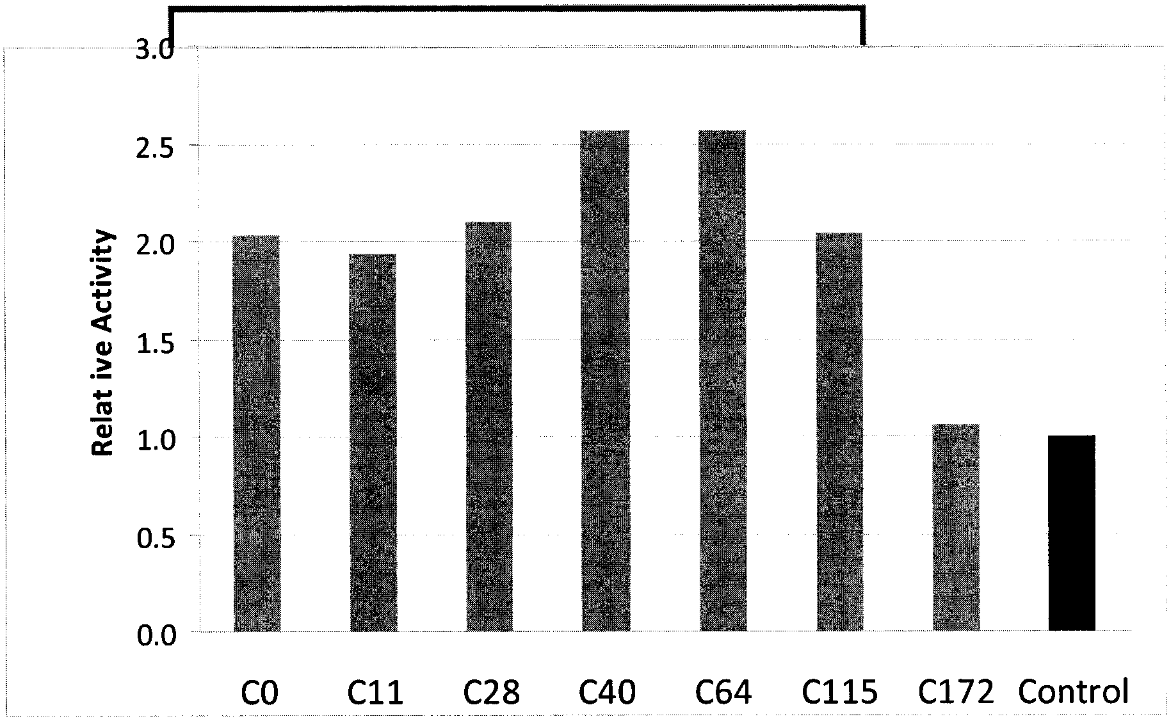

FIG. 5: Impact of truncations of the TALE C-terminal domain on AvrBs3-derived TALEN in yeast; truncated variants are represented by grey bars and AvrBs3-derived TALEN (control wt) is represented by a black bar; Activities are normalized to the AvrBs3-derived TALEN (Control wt) (SEQ ID NO: 5) activity on its 15 bp target (Avr15) (SEQ ID NO: 6).

Figure 6A:
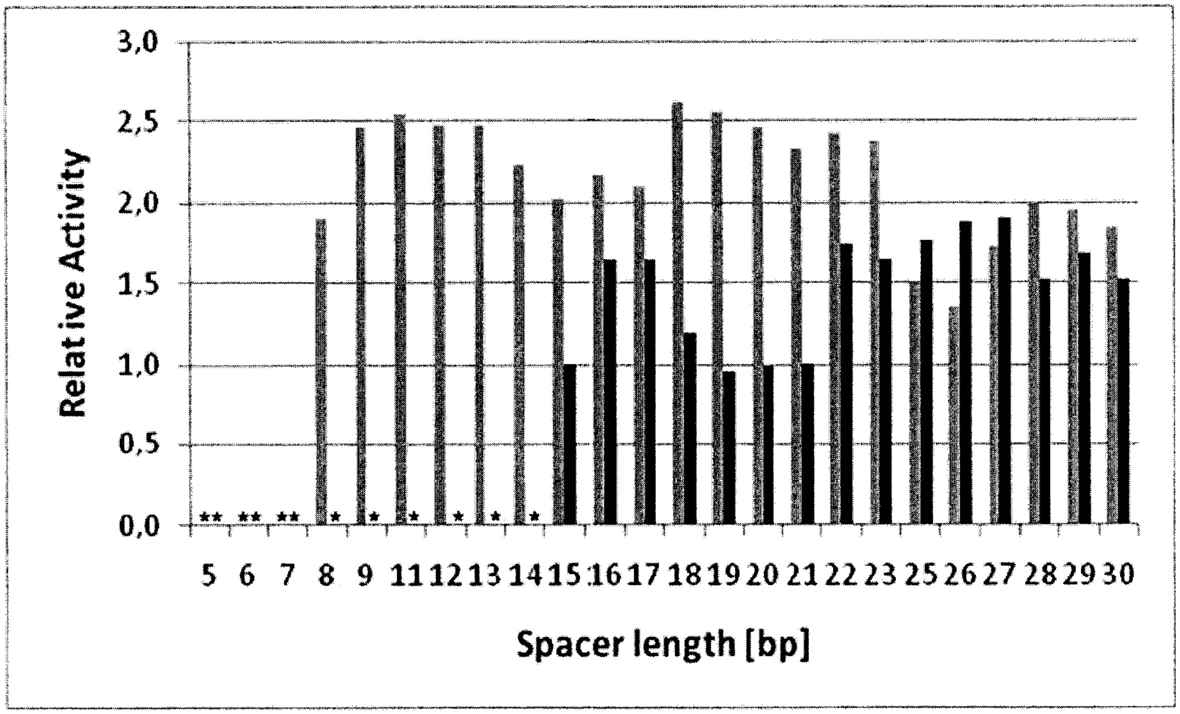
Figure 6B:
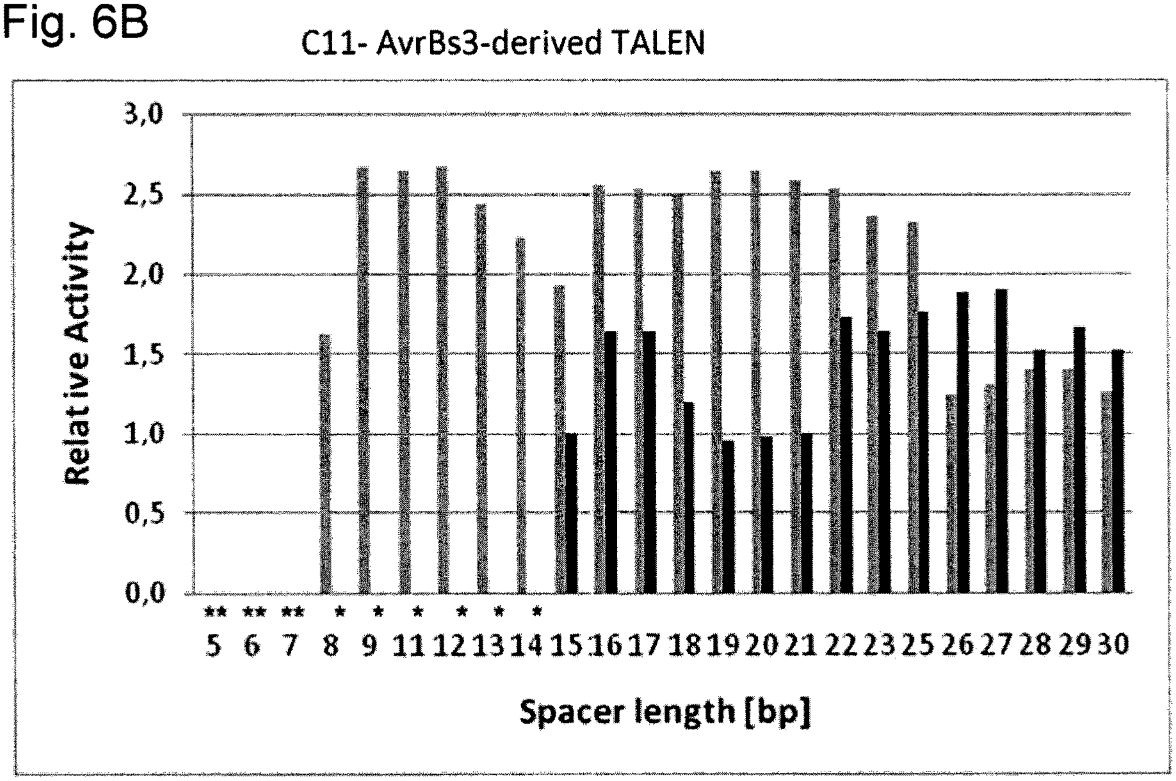
Figure 6C:
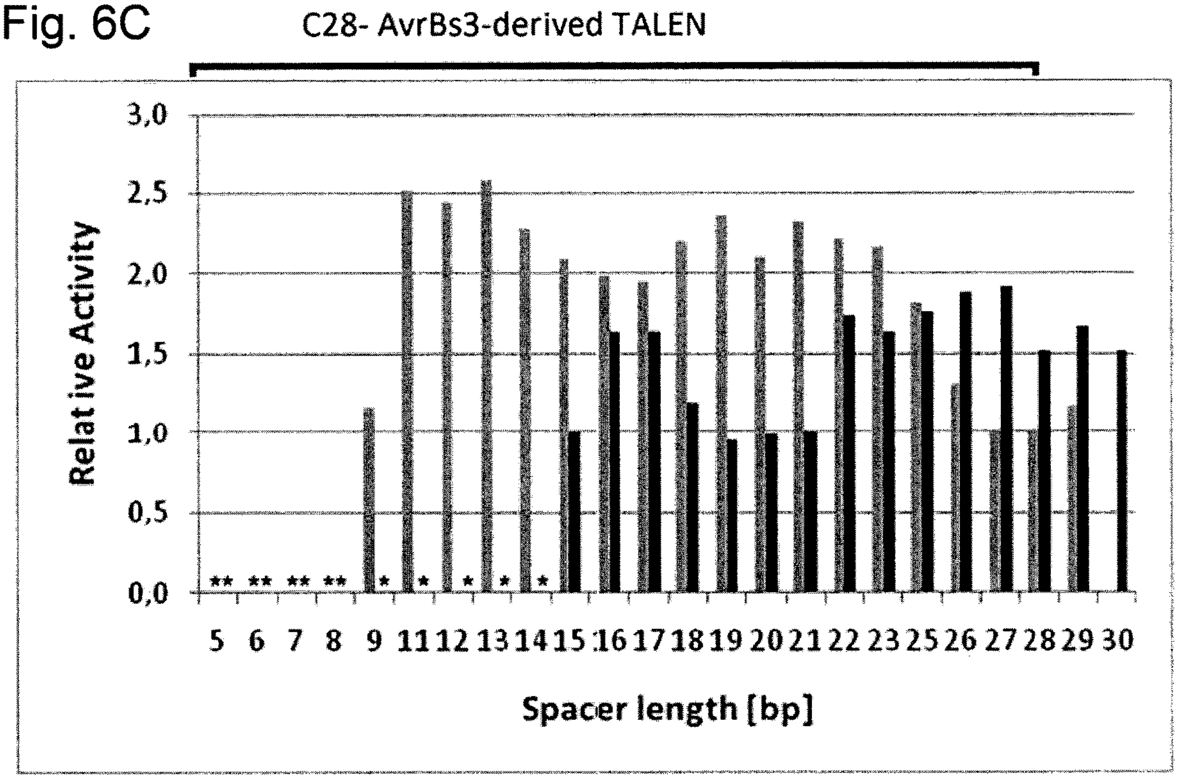
Figure 6D:
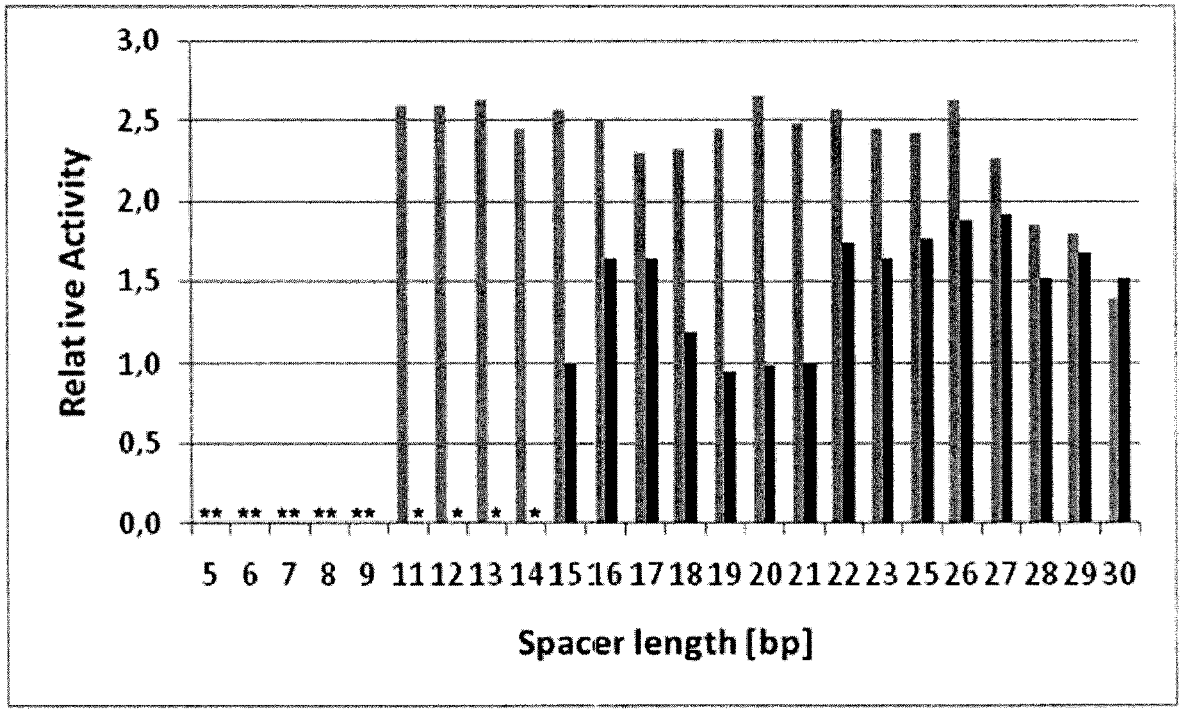
Figure 6E:
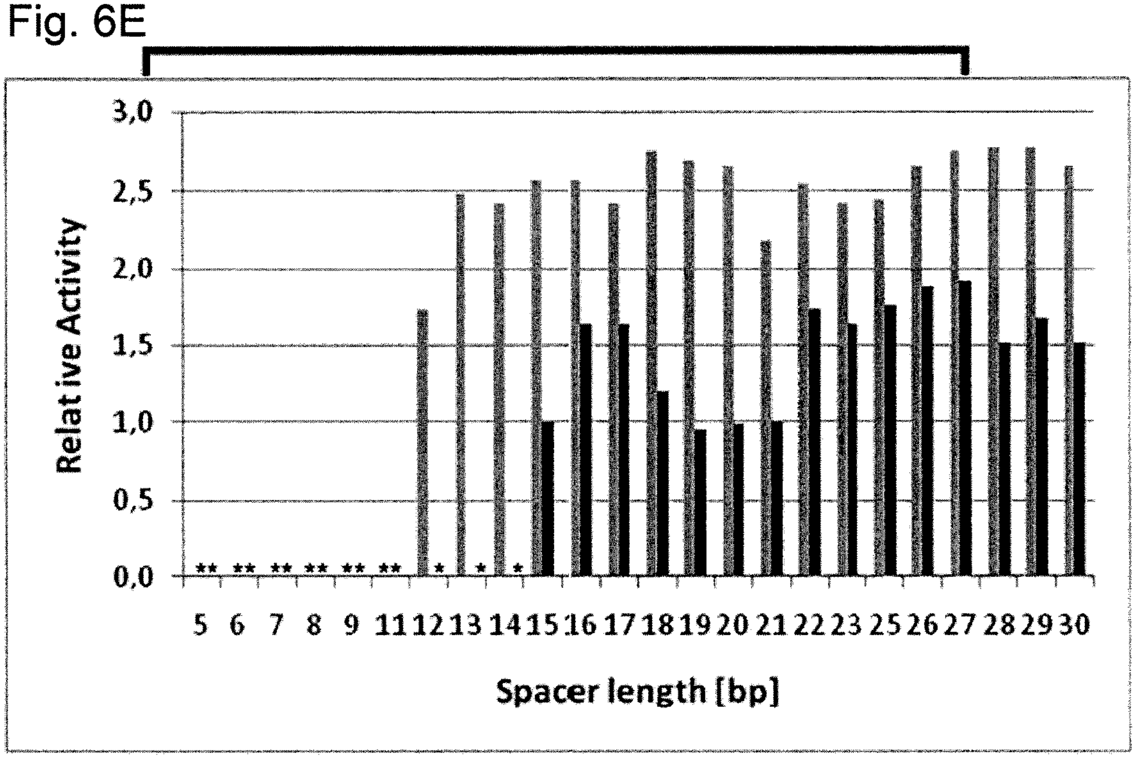
Figure 6F:
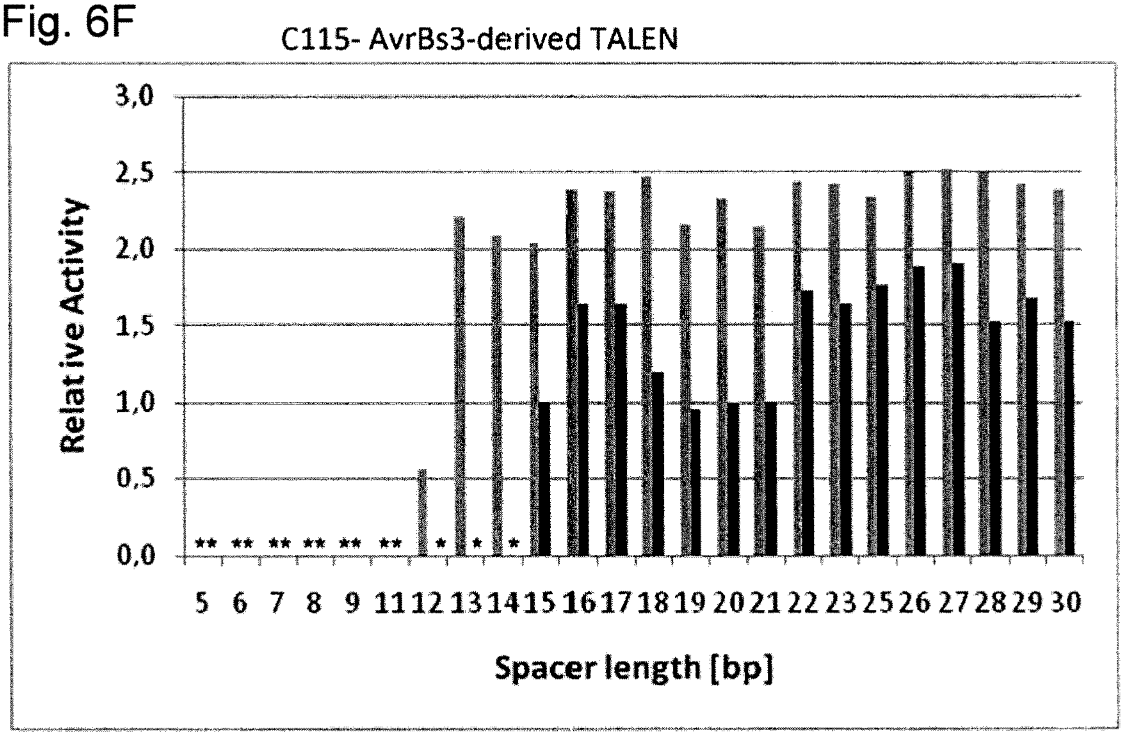
Figure 6G:
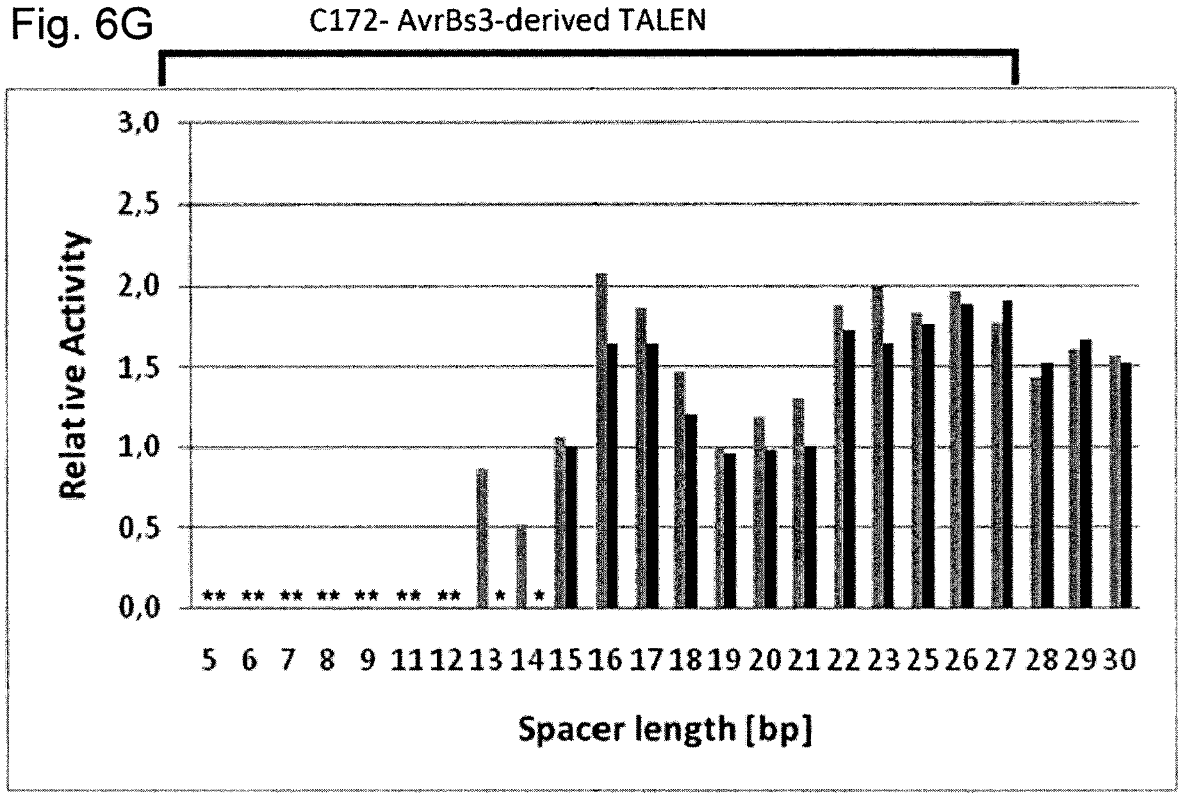

FIG. 6A-G: Activity in yeast of AvrBs3-derived TALENs comprising truncations of the C-terminal domain against targets of various spacer lengths. Effect of spacer length on: FIG. 6A, AVRBS3 TALEN having the C-terminal domain truncated after position E886 (CO) (SEQ ID NO: 19); CO truncated variant is represented by grey bars and AvrBs3-derived TALEN is represented by black bars. Activities are normalized to the AvrBs3-derived TALEN (Control wt) activity on its 15 bp target (Avr15). * indicates no detectable activity. FIG. 6B, AVRBS3 TALEN having the C-terminal domain truncated after position P897 (C11) (SEQ ID NO: 20); C11 truncated variant is represented by grey bars and AvrBs3-derived TALEN is represented by black bars. Activities are normalized to the AvrBs3-derived TALEN (Control wt) activity on its 15 bp target (Avr15). * indicates no activity over negative control. FIG. 6C, AVRBS3 TALEN having the C-terminal domain truncated after position G914 (C28) (SEQ ID NO: 21); C28 truncated variant is represented by grey bars and AvrBs3-derived TALEN is represented by black bars. Activities are normalized to the AvrBs3-derived TALEN (Control wt) activity on its 15 bp target (Avr15). * indicates no activity over negative control. FIG. 6D, AVRBS3 TALEN having the C-terminal domain truncated after position L926 (C40) (SEQ ID NO: 22); C40 truncated variant is represented by grey bars and AvrBs3-derived TALEN is represented by black bars. Activities are normalized to the AvrBs3-derived TALEN (Control wt) activity on its 15 bp target (Avr15). * indicates no activity over negative control. FIG. 6E, AVRBS3 TALEN having the C-terminal domain truncated after position D950 (C64) (SEQ ID NO: 23); C64 truncated variant is represented by grey bars and AvrBs3-derived TALEN is represented by black bars. Activities are normalized to the AvrBs3-derived TALEN (Control wt) activity on its 15 bp target (Avr15). * indicates no activity over negative control. FIG. 6F, AVRBS3 TALEN having the C-terminal domain truncated after position T1003 (C115) (SEQ ID NO: 24); C115 truncated variant is represented by grey bars and AvrBs3-derived TALEN is represented by black bars. Activities are normalized to the AvrBs3-derived TALEN (Control wt) activity on its 15 bp target (Avr15). * indicates no activity over negative control. FIG. 6G, AVRBS3 TALEN having the C-terminal domain truncated after position E1057 (C172) (SEQ ID NO: 25); C172 truncated variant is represented by grey bars and AvrBs3-derived TALEN is represented by black bars. Activities are normalized to the AvrBs3-derived TALEN (Control wt) activity on its 15 bp target (Avr15). * indicates no activity over negative control.

Figure 7:
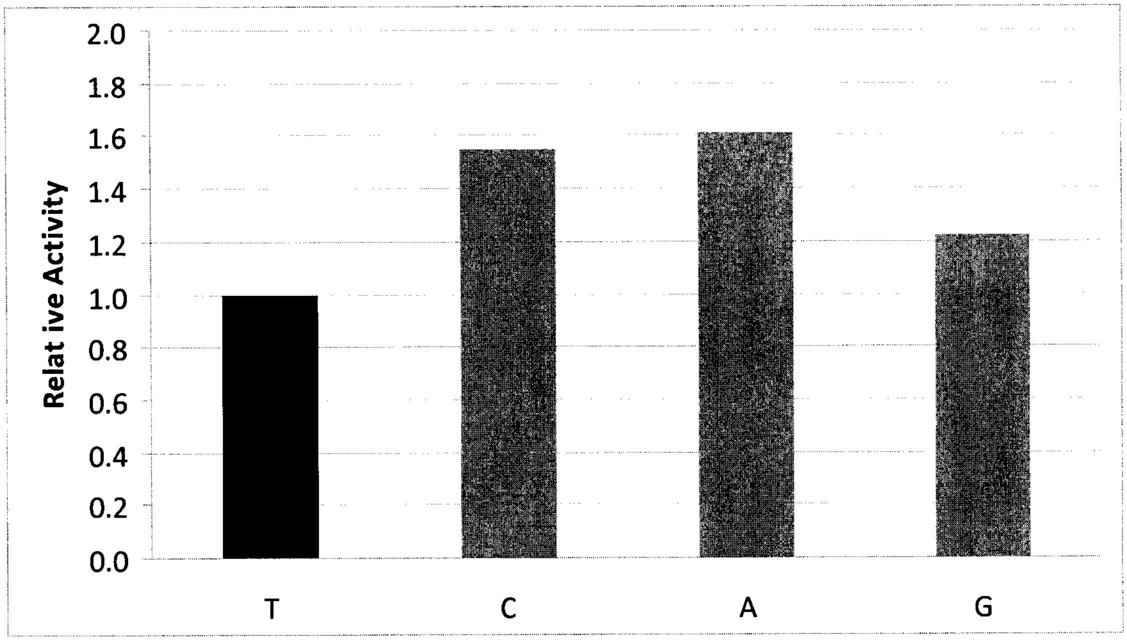

FIG. 7: Impact of nucleotide identity at position n of the target on the AvrBs3-derived TALEN activity (in yeast); Control target Avr15 with a T at position n is represented by a black bar. Activities are normalized to the AvrBs3-derived TALEN (Control wt) (SEQ ID NO: 5) activity on its 15 bp target (Avr15) (SEQ ID NO: 6).

Figure 8:
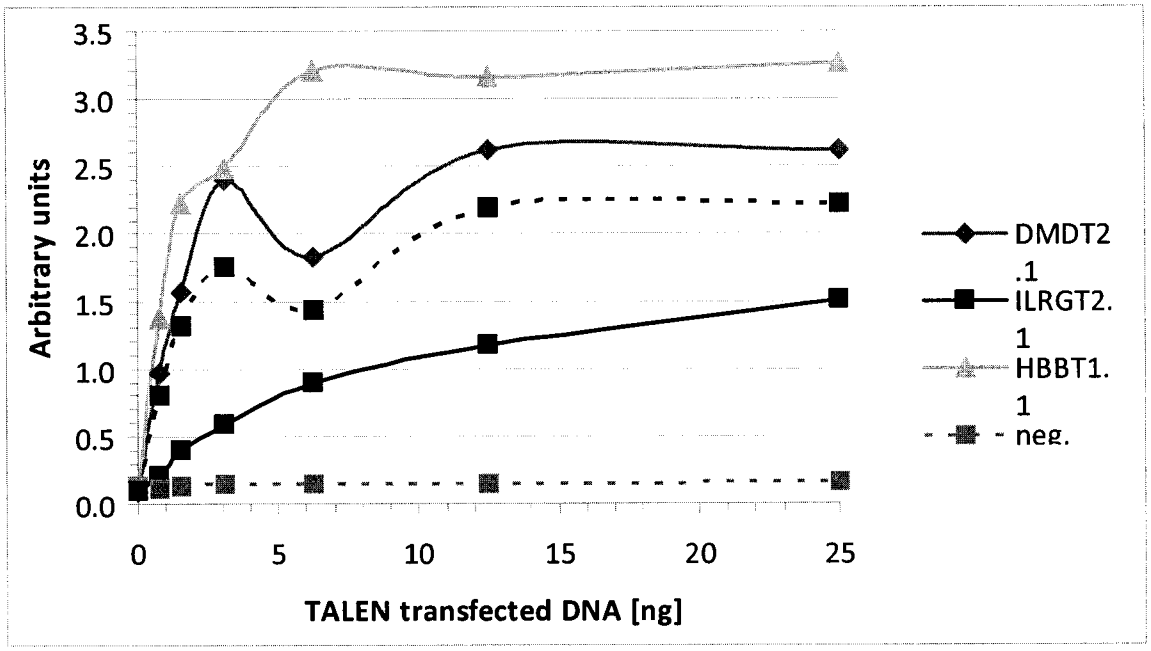

FIG. 8: Activity of engineered TALENs in mammalian cells (Extrachromosomic assay in CHO-K1); DMDT2.1 TALEN (SEQ ID NO: 180, SEQ ID NO: 186, SEQ ID NO: 189; example 6) is represented by a dark grey curve, ILRGT2.1 TALEN (SEQ ID NO: 181, SEQ ID NO: 187, SEQ ID NO: 190; example 6) is represented by a black curve, HBBT1.1 TALEN (SEQ ID NO: 182, SEQ ID NO: 188, SEQ ID NO: 192; example 6) is represented by a dark grey curve, negative control (empty vector) by a light grey dashed curve and positive control (I-SceI meganuclease) by a black dashed curve.

FIG. 9A-D: Schematic of chimeric protein configurations according to the invention.

FIG. 10A-E: Schematic of the method for optimizing the control of double-stranded break activity of a chimeric protein according to the invention.

Figure 11:
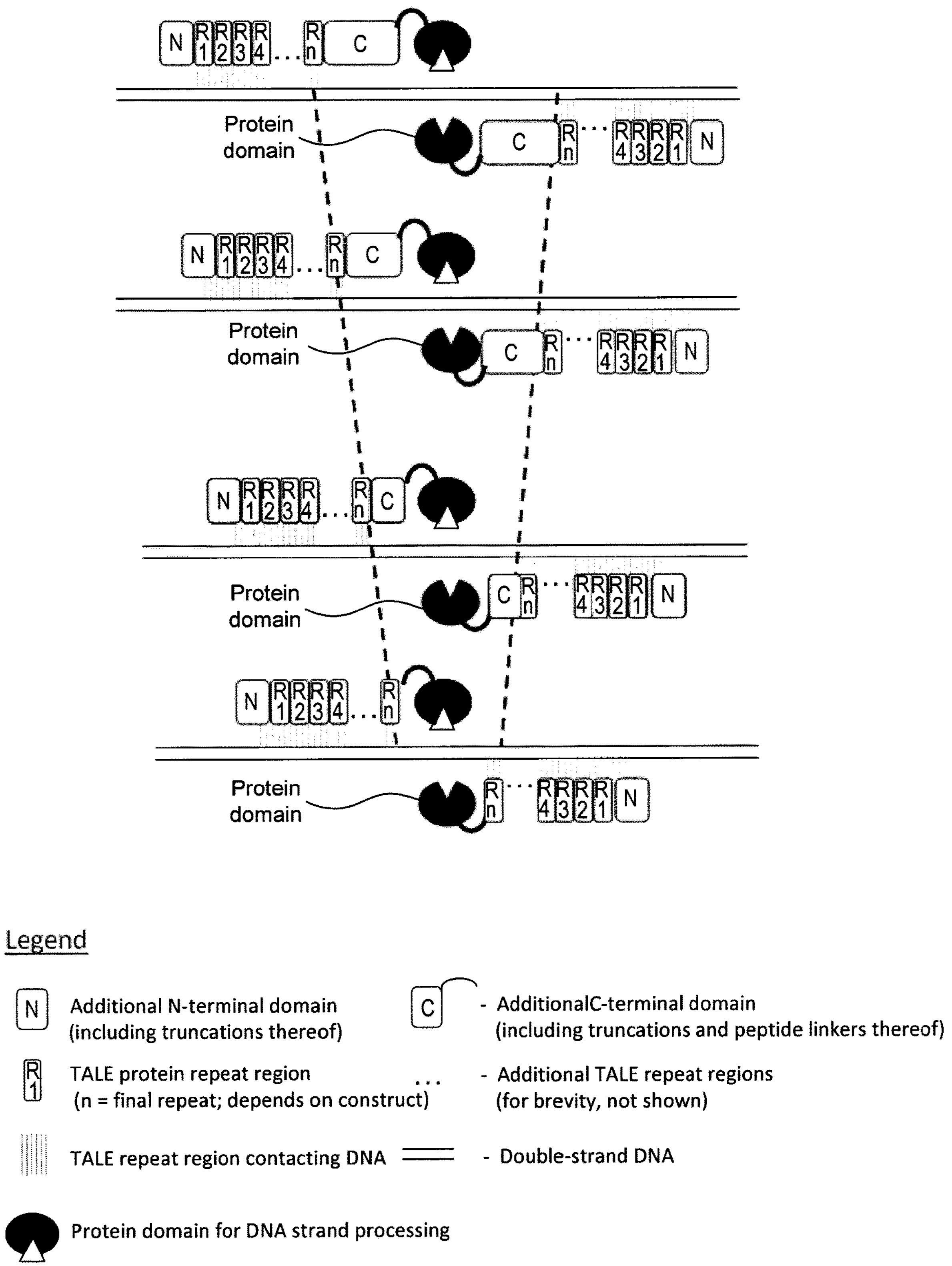

FIG. 11: Schematic of the method for increasing the number of targets that can be reach by a chimeric protein according to the invention.

FIG. 12: Activity of TALE-AvrBs3::TevI in yeast (37° C.). The negative control consists in a TALEN without any RVDs. n.d. indicates no detectable activity, + indicates an activity over 0.3 in yeast assay and +++ indicates an activity over 0.7 in yeast assay (International PCT Applications WO 2004/067736 and in Epinat, Arnould et al. 2003; Chames, Epinat et al. 2005; Arnould, Chames et al. 2006; Smith, Grizot et al. 2006).

Figure 13:
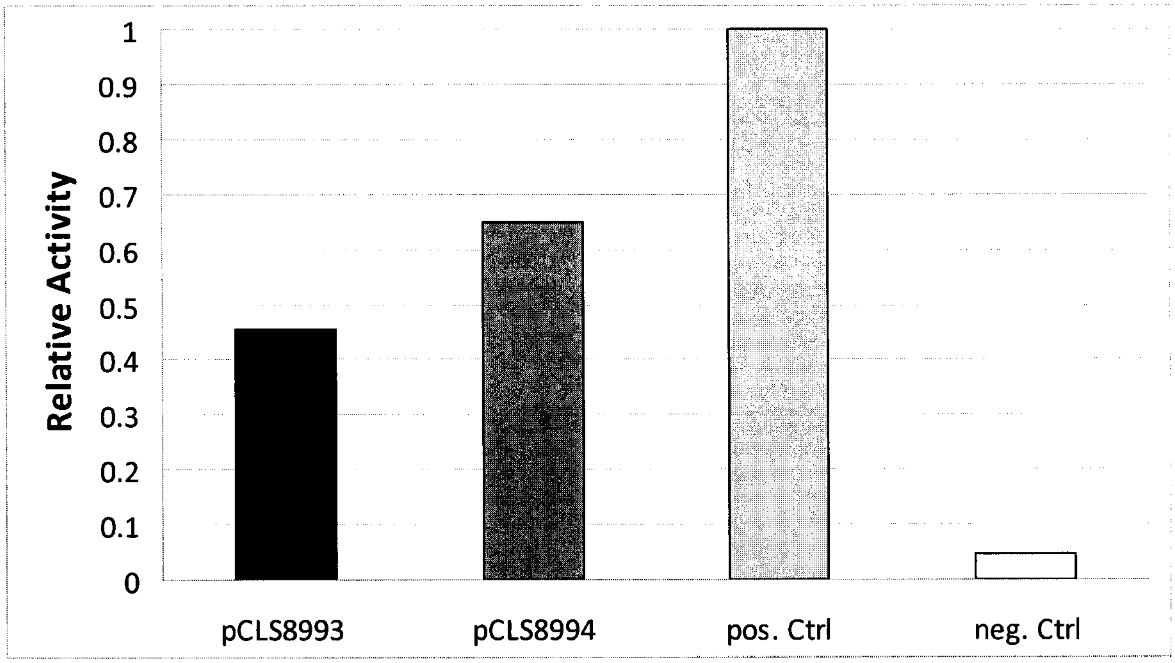
Figures 23A, 23B:
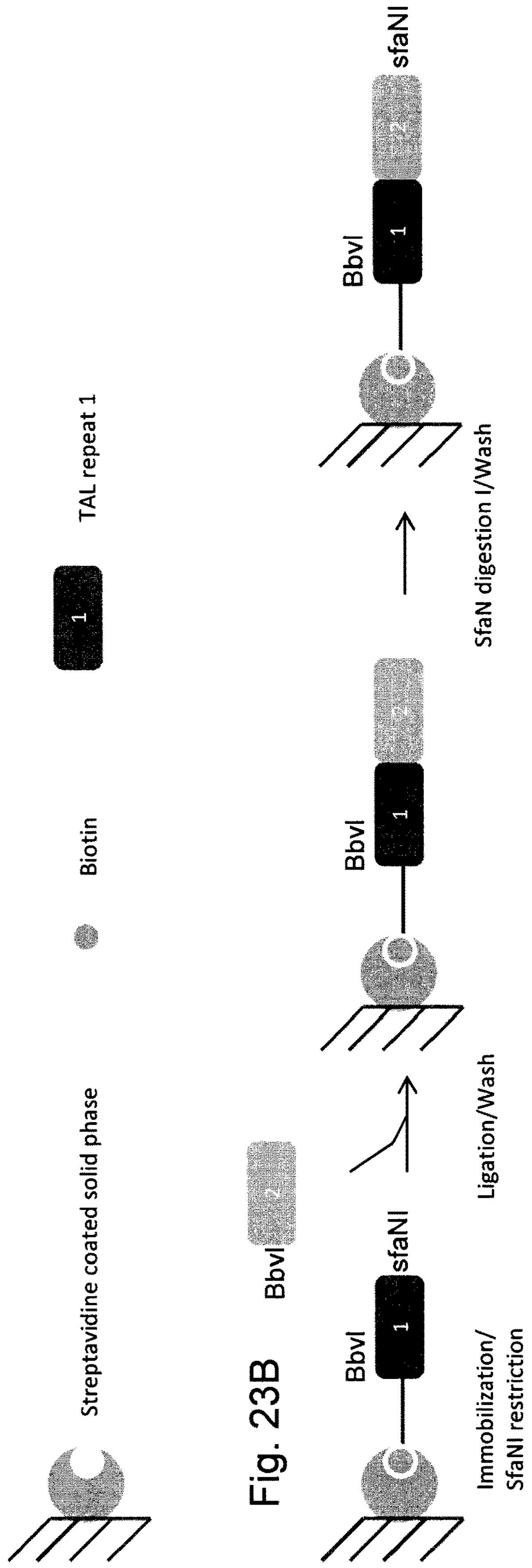
Figure 23C:
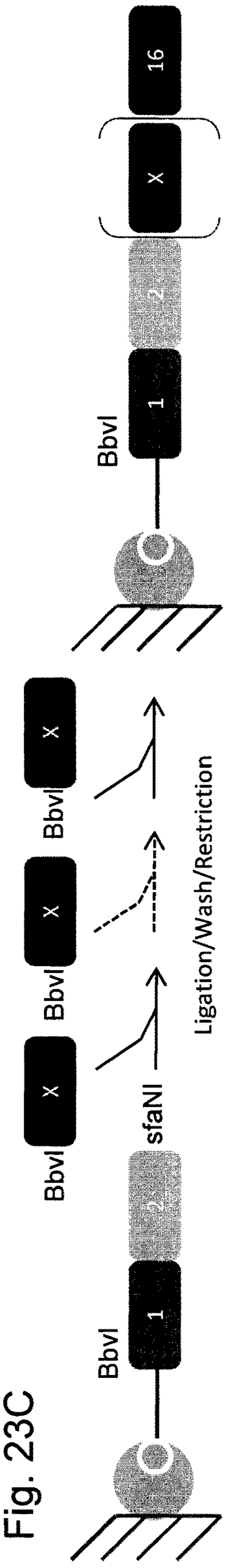
Figure 23D:
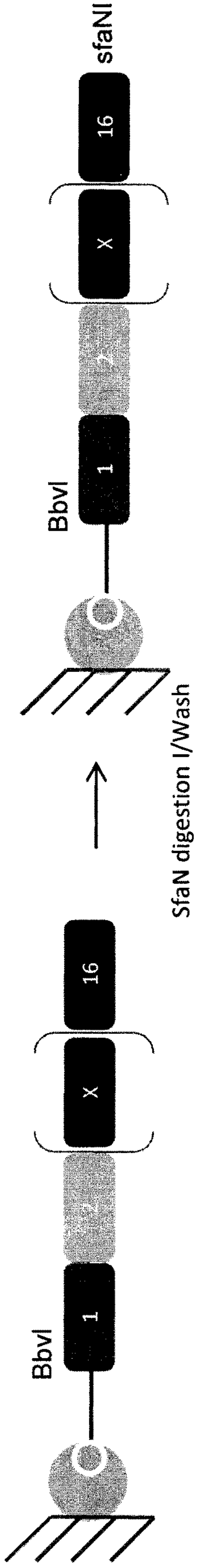
Figure 23E:
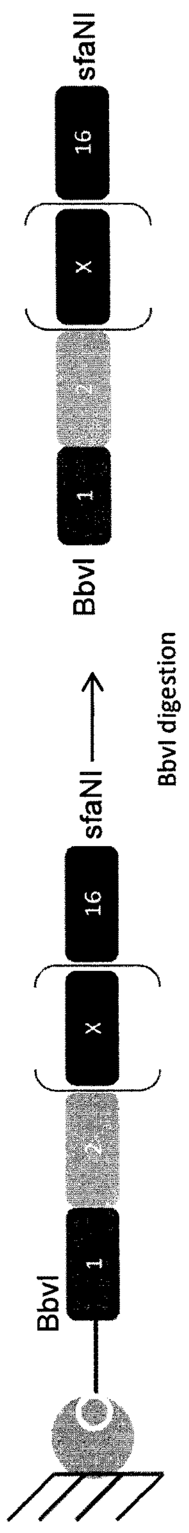
Figure 23F:
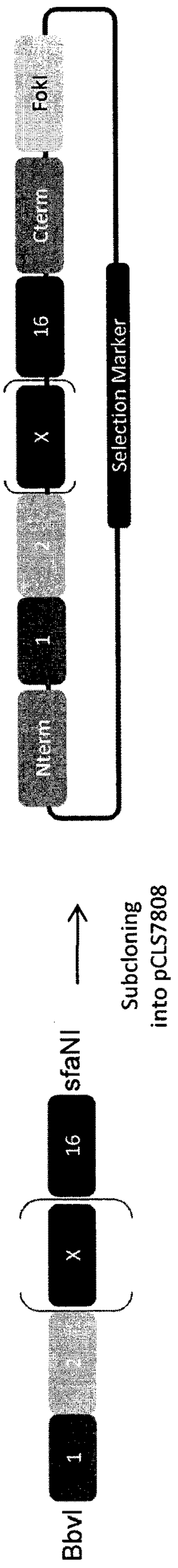

FIG. 13: Activity of TALE-AvrBs3::TevI in mammalian cells. (Extrachromosomic assay in CHO-K1). pCLS8993 (SEQ ID NO: 457) is represented by a black bar and pCLS8994 (SEQ ID NO: 458) is represented by a dark grey bar. Negative control (empty vector) by a white bar and positive control (I-SceI meganuclease) by a light grey bar. Data are normalized relative to the positive control.

FIG. 14: Activity of TALE-AvrBs3::NucA in yeast (37° C.). The negative control is a target lacking a recognition site (neg. ctrl.: SEQ ID NO: 472). Compact is a target having only one recognition site (SEQ ID NO: 468). n.d. indicates no detectable activity, + indicates an activity over 0.3 in yeast assay at 37° C.; ++ indicates an activity over 0.5 in yeast assay at 37° C. and +++ indicates an activity over 0.7 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 15: Activity of TALE-AvrBs3::ColE7 in yeast (37° C.). The negative control is a target lacking a recognition site (neg. ctrl.: SEQ ID NO: 472). Compact is a target having only one recognition site (SEQ ID NO: 468). n.d. indicates no detectable activity, + indicates an activity over 0.3 in yeast assay at 37° C.; ++ indicates an activity over 0.5 in yeast assay at 37° C. and +++ indicates an activity over 0.7 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIGS. 16 to 18, 19A, and 19B: Activity of asymmetrical TALENs in yeast (37° C.). n.d. indicates no detectable activity at 37° C., +/− indicated an activity above 0.3 in yeast assay at 37° C.; + indicated an activity over 0.3 in yeast assay at 37° C.; ++indicated an activity over 0.5 in yeast assay at 37° C.; +++ indicated an activity over 0.75 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 20: Activity of TALE-AvrBs3::EndoT7 in yeast (37° C.). n.d. indicates no detectable activity at 37° C., + indicated an activity over 0.3 in yeast assay at 37° C.; ++ indicated an activity over 0.5 in yeast assay at 37° C.; +++ indicated an activity over 0.75 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 21: Activity of colE7 (SEQ ID NO: 340), EndoT7 (SEQ ID NO: 363) and I-TevI (SEQ ID NO: 349) catalytic heads containing TALEN with various polypeptide linker in yeast (37° C.). Compact is a target having only one recognition site (SEQ ID NO: 224). n.d. indicates no detectable activity at 37° C., + indicated an activity over 0.3 in yeast assay at 37° C.; ++ indicated an activity over 0.5 in yeast assay at 37° C.; +++ indicated an activity over 0.75 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 22: Activity of TALEN having various polypeptide linkers (37° C).The negative control is a target lacking recognition sites. n.d. indicates no detectable activity at 37° C., +/− indicated an activity above 0.7 in yeast assay at 37° C.; +++ indicated an activity over 0.70 in yeast assay at 37° C. (International PCT Applications WO 2004/067736 and in Epinat, Arnould et al. 2003; Chames, Epinat et al. 2005; Arnould, Chames et al. 2006; Smith, Grizot et al. 2006).

FIG. 23 A-F: Tal repeats arrays assembly and subcloning into yeast expression plasmids. FIG. 23A. Legend of materials used for TAL repeat assembly. FIG. 236. immobilization of the first biotinylated TAL repeat fragment on a streptavidin coated solid support and ligation to a second TAL repeat harboring SfaNI compatible overhangs (BbvI overhangs displayed in red). FIG. 23C. consecutive ligation/restriction of TAL repeats to generate the complete TAL repeats array. FIG. 23D. SfaNI digestion of the TAL repeats array. FIG. 23E. BbvI digestion and recovery of the TAL repeats array. FIG. 23F. Subcloning of TAL repeats array into yeast expression plasmids harboring the Nterminal domain of AvrBs3 TAL effector, the forty first amino acids of its Cterminal domain fused to FokI type IIS restriction endonuclease FIG. 24. Influence of TAL repeat number on TALEN activity. TALEN activities of 52 different TALENs (SEQ ID NO: 507-558) bearing from 9.5 to 15.5 TAL repeats were determined. The mean values of TALEN activities are displayed as a function of TAL repeat number; error bars represent the standard deviation of activities of TALENs bearing the same number of TAL repeats.

FIG. 25A-D. Influence of different single protein/DNA mismatches at position N-1 or N-2 on TALEN activity as a function of TAL repeat number.

Figure 25A:
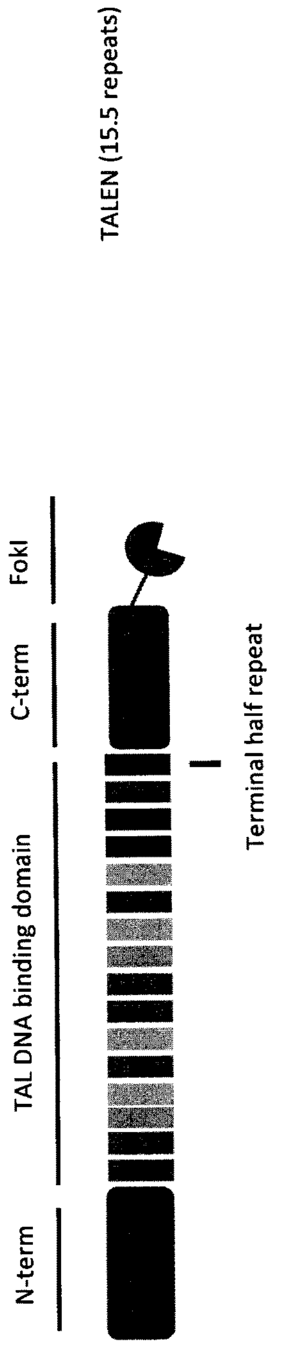

FIG. 25A. Presentation of the different components constituting a TALEN.

Figure 25B:
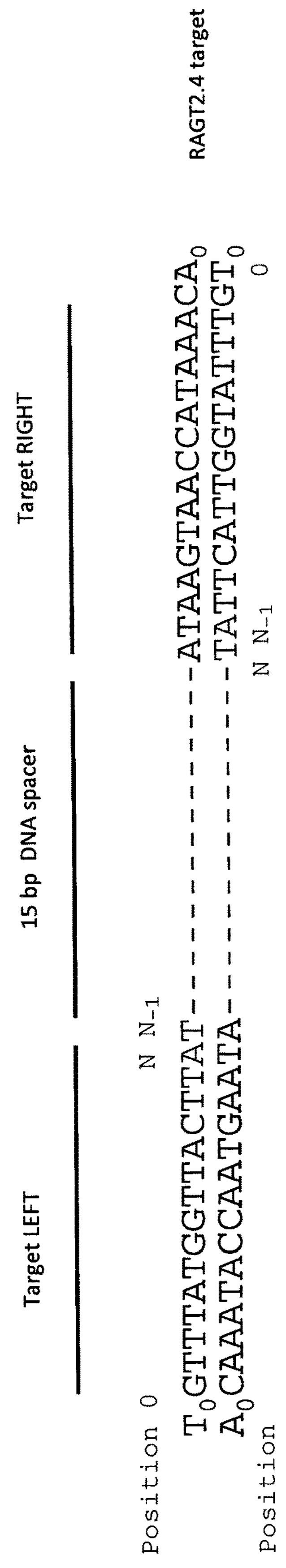

FIG. 25B. Presentation of a homodimeric RAGT2.4 target (SEQ ID NO: 601).

Figure 25C:
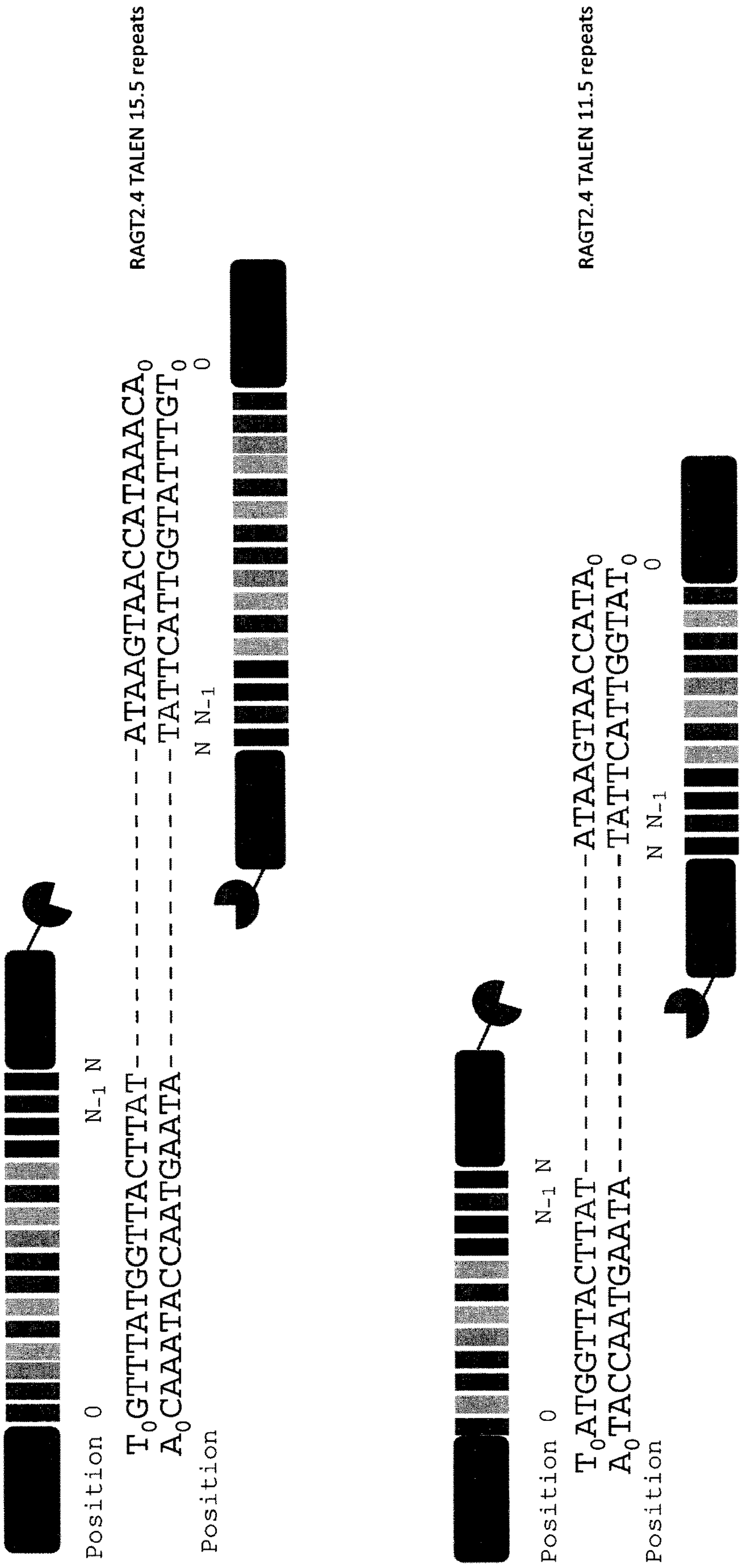

FIG. 25C. Examples of RAGT2.4 TALENs bearing 15.5 or 11.5 Tal repeats (SEQ ID NO: 617 or 622) along with their respective DNA targets (top and bottom respectively).

FIG. 25D. Experimental results reporting RAGT2.3 and RAGT2.4 TALEN activities as a function of TAL repeat number and nature of mismatch at N and N-1 positions.

FIG. 26. Influence of C-terminal domain substitution by polypeptide linkers 8, 27 and 35 on AvrBs3 TALEN nuclease activity in yeast. AvrBs3 TALENs bearing polypeptide linkers 8, 27 and 35 (SEQ ID: 141, 160 and 168) as C-terminal domain were assayed toward AvrBs3 homodimeric targets bearing from 5 to 30 bp DNA spacer. Their yeast activities are displayed as a function of spacer length.

FIG. 27: Activities for novel variations of the TALE::FokI scaffold. The negative control consists in a TALEN without any RVDs. n.d. indicates no detectable activity, + indicates an activity between 0.3 and 0.5 in our assay, ++ indicates an activity between 0.5 and 0.7 in our assay and +++ indicates an activity over 0.7 in our assay (International PCT Applications WO 2004/067736 and in Epinat, Arnould et al. 2003; Chames, Epinat et al. 2005; Arnould, Chames et al. 2006; Smith, Grizot et al. 2006).

FIG. 28: Activities of combination TALE::FokI and FokI::TALE in yeast. The negative control consists in a TALEN without any RVDs. n.d. indicates no detectable activity, ++ indicates an activity between 0.5 and 0.7 in our assay and +++ indicates an activity over 0.7 in our assay (International PCT Applications WO 2004/067736 and in Epinat, Arnould et al. 2003; Chames, Epinat et al. 2005; Arnould, Chames et al. 2006; Smith, Grizot et al. 2006).

FIG. 29: List of AvrBs3 targets with various spacer lengths (SEQ ID NO: 220 to 255).

FIG. 30: List of AvrBs3 targets with all combination at position n (SEQ ID NO: 171 to 174).

FIG. 31: List of AvrBs3/RAGT2 (heterodimer) targets with various spacer lengths (SEQ ID NO: 256 to 291).

FIG. 32: Activities of 27 custom TALEN tested as homodimers, in four different scaffolds (full wt C-terminal domain, CO truncated C-terminal domain, C11 truncated C-terminal domain and C40 truncated C-terminal domain); (n.a: non available; n.d: non detected) (SEQ ID NO: 26 to 133).

FIG. 33: Binding and target sequences of 27 custom TALEN (homodimers) (SEQ ID NO: 193 to 219).

FIG. 34: List of AvrBs3 targets with various spacer lengths (SEQ ID NO: 220 to 255) including a target with only one recognition site (compact, SEQ ID NO: 468) and a negative control target (neg. ctrl., SEQ ID NO: 472) consisting in a target without any recognition site.

FIG. 35: List of AvrBs3 targets containing two identical recognition sequences juxtaposed with the 5' ends proximal and separated by "spacer" DNA ranging from 5 to 35 bps (SEQ ID NO: 629 to 659).

FIG. 36: List of RagT2-R/AvrBs3 hybrid targets contain two different recognition sequences juxtaposed with the 3' end of the first (RagT2-R) proximal to the 5' end of the second (AvrBs3) and separated by "spacer" DNA ranging from 5 to 40 bps (SEQ ID NO: 666 to 701),

DETAILED DESCRIPTION OF THE INVENTION

Unless specifically defined herein, all technical and scientific terms used have the same meaning as commonly understood by a skilled artisan in the fields of gene therapy, biochemistry, genetics, and molecular biology.

All methods and materials similar or equivalent to those described herein can be used in the practice or testing of the present invention, with suitable methods and materials being described herein. All publications, patent applications, patents, and other references mentioned herein are incorporated by reference in their entirety. In case of conflict, the present specification, including definitions, will prevail. Further, the materials, methods, and examples are illustrative only and are not intended to be limiting, unless otherwise specified.

The practice of the present invention will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Current Protocols in Molecular Biology (Frederick M. AUSUBEL, 2000, Wiley and son Inc, Library of Congress, USA); Molecular Cloning: A Laboratory Manual, Third Edition, (Sambrook et al, 2001, Cold Spring Harbor, N.Y.: Cold Spring Harbor Laboratory Press); Oligonucleotide Synthesis (M. J. Gait ed., 1984); Mullis et al. U.S. Pat. No. 4,683,195; Nucleic Acid Hybridization (B. D. Harries & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the series, Methods In ENZYMOLOGY (J. Abelson and M. Simon, eds.-in-chief, Academic Press, Inc., New York), specifically, Vols.154 and 155 (Wu et al. eds.) and Vol. 185, "Gene Expression Technology" (D. Goeddel, ed.); Gene Transfer Vectors For Mammalian Cells (J. H. Miller and M. P. Calos eds., 1987, Cold Spring Harbor Laboratory); Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); and Manipulating the Mouse Embryo, (Cold Spring Harbor Laboratory Press, Cold Spring Harbor, N.Y., 1986).

In a general aspect, the present invention relates to new Transcription Activator-Like Effector proteins and more particularly new Transcription Activator-Like Effector Nucleases (TALENs) that can efficiently target and process nucleic acids. According to a first aspect of the present invention is a chimeric protein constituted by a core scaffold comprising a DNA binding domain and a protein domain to process a nucleic acid target sequence.

In a first embodiment, the present invention relates to a chimeric protein derived from a Transcription Activator-Like Effector (TALE) comprising:

(I) A core scaffold comprising Repeat Variable Dipeptide regions (RVDs) having specificity to bind a nucleic acid sequence adjacent to a nucleic acid target sequence to process;

(ii) A catalytic domain to process said nucleic acid target sequence.

In another embodiment, said chimeric protein further comprises a peptidic linker to fuse said catalytic domain to said core scaffold.

In another embodiment is a chimeric protein constituted by a core scaffold comprising a DNA binding domain and a protein domain to process a nucleic acid target sequence. In a preferred embodiment of this first aspect is a chimeric protein derived from a Transcription Activator-Like Effector (TALE) comprising:

(i) A core scaffold comprising a set of Repeat Variable Dipeptide regions (RVDs) able to bind a nucleic acid sequence adjacent to a nucleic acid target sequence to process wherein each RVD comprises a pair of amino acids responsible for recognizing one nucleotide selected from the group consisting of HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A.

(ii) A catalytic domain to process said nucleic acid target sequence.

In another embodiment, the chimeric protein of the present invention is derived from any naturally occurring TAL effectors, such as those described in Bogdanove et al. (Boch and Bonas 2010; Bogdanove, Schornack et al. 2010) and listed in Boch et al. (Boch and Bonas 2010). In a preferred embodiment, the chimeric protein of the present invention is derived from any TAL effectors of plant pathogenic bacteria in the genus Xanthomonas as listed in Boch et al (Boch and Bonas 2010) as a non-limiting example. In another embodiment, only one part of the core scaffold is derived from a TAL effector; as an illustrative example, only said set of Repeat Variable Dipeptide regions is derived from a TAL effector.

In another embodiment, each RVD of said core scaffold is made of 30 to 42 amino acids, more preferably 33 or 34 wherein two critical amino acids located at positions 12 and 13 mediates the recognition of one nucleotide of said nucleic acid target sequence; equivalent two critical amino acids can be located at positions other than 12 and 13 specialy in RVDs taller than 33 or 34 amino acids long. Preferably, RVDs associated with recognition of the different nucleotides are HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A. More preferably, RVDs associated with recognition of the nucleotides C, T, A, G/A and G respectively are selected from the group consisting of NN or NK for recognizing G, HD for recognizing C, NG for recognizing T and NI for recognizing A, TL for recognizing A, VT for recognizing A or G and SW for recognizing A. In another embodiment, RVDS associated with recognition of the nucleotide C are selected from the group consisting of N* and RVDS associated with recognition of the nucleotide T are selected from the group consisting of N* and H*, where * denotes a gap in the repeat sequence that corresponds to a lack of amino acid residue at the second position of the RVD. In another embodiment, critical amino acids 12 and 13 can be mutated towards other amino acid residues in order to modulate their specificity towards nucleotides A, T, C and G and in particular to enhance this specificity. By other amino acid residues is intended any of the twenty natural amino acid residues or unnatural amino acids derivatives.

In another embodiment, said core scaffold of the present invention comprises between 8 and 30 RVDs. More preferably, said core scaffold of the present invention comprises between 8 and 20 RVDs; again more preferably 15 RVDs.

In another embodiment, said core scaffold comprises an additional single truncated RVD made of 20 amino acids located at the C-terminus of said set of RVDs, i.e. an additional C-terminal half-RVD. In this case, said core scaffold of the present invention comprises between 85 and 30.5 RVDs, ".5" referring to previously mentioned half-RVD (or terminal RVD, or half-repeat). More preferably, said core scaffold of the present invention comprises between 8.5 and 20.5 RVDs, again more preferably, 15.5 RVDs. In a preferred embodiment, said half-RVD is in a core scaffold context which allows a lack of specificity of said half-RVD toward nucleotides A, C, G, T. In a more preferred embodiment, said half-RVD is absent.

In another embodiment, said core scaffold of the present invention comprises RVDs of different origins. In a preferred embodiment, said core scaffold comprises RVDs originating from different naturally occurring TAL effectors. In another preferred embodiment, internal structure of some RVDs of the core scaffold of the present invention are constituted by structures or sequences originated from different naturally occurring TAL effectors. In another embodiment, said core scaffold of the present invention comprises RVDs-like domains. RVDs-like domains have a sequence different from naturally occurring RVDs but have the same function and/or global structure within said core scaffold of the present invention. As non-limiting examples, said RVDs-like domains are protein domains selected from the group consisting of Puf RNA binding protein or Ankyrin superfamily. Non-limiting examples of such proteins from which RVDs-like domain can be derived are given by SEQ ID NO: 398 and SEQ ID NO: 399 respectively corresponding to proteins fem-3 and aRep. Depending on the structural context and binding constraints, said core scaffold of the chimeric protein of the present invention comprises a mix of naturally occurring RVDs structures and RVDs-like domains.

In another embodiment, said core scaffold of the present invention is entirely composed by RVDs-like domains that are not originated from pathogenic organisms. In this embodiment, said core scaffold of the chimeric protein of the present invention is totally artificial, i.e. without any RVDs-like domains derived from naturally occurring TAL effectors.

In another embodiment, are encompassed variants of naturally occurring RVDs enriching the code mentioned above by mutating critical amino acids located at positions 12 and 13 towards other existing amino acids. Such mutations can also overcome nucleic acid modifications such as DNA alkylation (acetylation, methylation) as a non-limiting example; in this case, the core scaffold of the chimeric protein of the invention can have a higher selectivity for a methylated or unmethylated target sequence; in other words, said core scaffold can tolerate nucleic acid methylation or can be specific of a methylated target sequence. In another embodiment, are encompassed variants of naturally occurring RVDs that are mutated in other amino acids of structural importance. As a non-limiting example, VVAIA and LLPVL amino acids motifs in RVDs may be of structural importance for hydrophobic contact between helices of adjacent RVD and may represent good candidate motifs to mutate for modulating the intra RVD interactions or interdependency between adjacent RVDs in a set of repeated variable domains and thus the affinity and specificity of subsequent TALENs. In another embodiment of the present invention are also encompassed RVDs variants mutated at these residues to modify interactions between adjacent RVDs resulting in a core scaffold of the present invention with more rigidity. At the opposite, are also encompassed in the scope of the chimeric protein of the present invention RVDs variants mutated at these residues to obtain a core scaffold with more flexibility. More or less rigidity in core scaffolds of the present invention allows to enhance or decrease protein-protein interactions within the structure of the scaffold, particularly when adjacent RVDs in said core scaffold are from different origins; also, it allows to modify protein-nucleic acid interactions between said core scaffold of the chimeric protein of the present invention and its nucleic acid target. Modifications of protein-protein or protein-nucleic acid interactions can be quantified by measuring biochemical constants [affinity (Ka)/dissociation (Kd)/turn over (Kcat) constants] associated with such interactions/reactions.

In another embodiment, said core scaffold of the present invention comprises one additional domain at the N-terminus of said set of Repeat Variable Dipeptide regions. In another embodiment, said additional N-terminus domain is derived from the N-terminus domain of a naturally occurring TAL effector. In another embodiment, said additional N-terminus domain is the full-length N-terminus domain of a naturally occurring TAL effector N-terminus domain. In another embodiment, said additional N-terminus domain is a variant of a naturally occurring Tal effector. In another embodiment, said additional domain is a truncated variant of a naturally occurring TAL effector N-terminus domain. In another embodiment, said additional domain is a truncated version of AvrBs3 TAL effector. In another embodiment, said truncated version lacks at its C-terminus extremity the peptidic sequence that confers specificity to position 0 of the recognized and bound sequence, i.e. the "RVDO" repeat, named for a postulated $0^{th}$ repeat that has only weak sequence similarity but a predicted structural similarity to the repeats in Bogdanove et al. (Bogdanove 2010 current opinion). In another embodiment, said truncated version lacks at least one amino acid residue selected from the group consisting of the 152 first N-terminal amino acids residues. In another embodiment, said truncated version lacks more than the first 152 amino acids residues.

In another embodiment, said additional N-terminus domain is a non-TAL effector originating domain. In another embodiment, said additional N-terminus domain is derived from a protein having non-specific nucleic acid binding characteristics. In this embodiment, said additional N-terminus domain is derived from a protein having non-specific DNA binding characteristics. In this embodiment, said additional N-terminus domain is derived from a protein having non-specific RNA binding characteristics. In another embodiment, said additional N-terminus domain is derived from a protein having specific nucleic acid binding characteristics, such as non-limiting examples, meganucleases or zinc-finger proteins or derivatives of those such as variants with only DNA binding activity. In another embodiment, said additional N-terminus domain is a chimeric domain comprising a TAL effector originating subdomain and a non-TAL effector originating subdomain.

In another embodiment, said additional N-terminus domain is a variant increasing the affinity of said core scaffold of the chimeric protein of the present invention toward its binding nucleic acid sequence. In another embodiment, said additional N-terminus domain is a variant which allows overcoming sequence constraints associated with said RVDO, i.e. the necessity to have a T as the first base on binding nucleic acid sequence. In a preferred embodiment, said additional N-terminus domain is a variant which allows changing this sequence constraint to A, G or C respectively. In a more preferred embodiment, said additional N-terminus domain is a variant which allow suppressing the sequence constraints associated with RVDO.

In another embodiment, said additional N-terminus domain of the core scaffold of the chimeric protein of the present invention comprises a localization sequence (or signal) which allows targeting said chimeric protein toward a given organelle within an organism, a tissue or a cell. Non-limiting examples of such localization signals are nuclear localization signals, chloroplastic localization signals or mitochondrial localization signals. In another embodiment, said additional N-terminus domain can comprise a nuclear export signal having the opposite effect of a nuclear localization signal to help targeting organelles such as chloroplasts or mitochondria. In the scope of the present invention are also encompassed additional N-terminus domains with a combination of several localization signals. Such combinations can be as a non-limiting example a nuclear localization signal and a tissue-specific signal to help addressing said chimeric protein of the present invention in the nuclear of tissue specific cells.

In another embodiment, said additional N-terminal domain can be fused with a protein domain, a protein module, an antibody (or part of it) or a tag of interest, well-known in the art, for a specific application. In another embodiment, said additional N-terminal domain can be linked with a chemical molecule such as a small compound of interest for a defined application.

In a preferred embodiment, said additional domain at the N-terminus of said set of Repeat Variable Dipeptide regions of said core scaffold of the present invention is selected from the group consisting of SEQ ID NO: 292, SEQ ID NO: 293 and SEQ ID NO: 401 or derivatives thereof.

In another embodiment, said core scaffold of the present invention comprises one additional domain at the C-terminus of said set of Repeat Variable Dipeptide regions. In another embodiment, said additional C-terminus domain is derived from the C-terminus domain of a naturally occurring TAL effector. In another embodiment, said additional C-terminus domain is the full-length C-terminus domain of a naturally occurring TAL effector. In another embodiment, said additional C-terminus domain is a variant of a naturally occurring Tal effector C-terminus domain. In another embodiment, said additional domain is a truncated variant of a naturally occurring TAL effector C-terminus domain. In another embodiment, said truncated version is a C-terminus domain without Activation Domain (SEQ ID NO: 400 and 402). In another embodiment, said additional domain is a truncated version of AvrBs3 TAL effector. In another embodiment, said additional domain is truncated after position E886 (CO). In another embodiment, said additional domain is truncated after position P897 (C11; SEQ ID NO: 295). In another embodiment, said additional domain is truncated after position G914 (C28; SEQ ID NO: 296). In another embodiment, said additional domain is truncated after position L926 (C40; SEQ ID NO: 297). In another embodiment, said additional domain is truncated after position D950 (C64; SEQ ID NO: 298). In another embodiment, said additional domain is truncated after position R1000 (C115; SEQ ID NO: 299). In another embodiment, said additional domain is truncated after position D1059 (C172; SEQ ID NO: 300) (amino acid numbering refers to C-terminus domain of AvrBs3 TAL effector).

In another embodiment, said additional C-terminus domain is a non-TAL effector originating domain. In another embodiment, said additional C-terminus domain is derived from a protein having non-specific nucleic acid binding characteristics. In this embodiment, said additional C-terminus domain is derived from a protein having non-specific DNA binding characteristics. In this embodiment, said additional C-terminus domain is derived from a protein having non-specific RNA binding characteristics. In another embodiment, said additional C-terminus domain is derived from a protein having specific nucleic acid binding characteristics, such as non-limiting examples, meganucleases or zinc-finger proteins or derivatives of those such as variants with only DNA binding activity. In another embodiment, said additional C-terminus domain is a chimeric domain comprising a TAL effector originating subdomain and a non-TAL effector originating subdomain.

In another embodiment, said additional C-terminus domain is a variant increasing the affinity of said core scaffold of the chimeric protein of the present invention toward its binding nucleic acid sequence.

In another embodiment, said additional C-terminus domain of the core scaffold of the chimeric protein of the present invention comprises a localization sequence (or signal) which allows targeting said chimeric protein toward a given organelle within an organism, a tissue or a cell. Non-limiting examples of such localization signals are nuclear localization signals, chloroplastic localization signals or mitochondrial localization signals. In another embodiment, said additional C-terminus domain can comprise a nuclear export signal having the opposite effect of a nuclear localization signal to help targeting organelles such as chloroplasts or mitochondria. In the scope of the present invention are also encompassed additional C-terminus domains with a combination of several localization signals. Such combinations can be as a non-limiting example a nuclear localization signal and a tissue-specific signal to help addressing said chimeric protein of the present invention in the nuclear of tissue specific cells.

In another embodiment, said additional C-terminal domain can be fused with a protein domain, a protein module, an antibody (or part of it) or a tag of interest, well-known in the art, for a specific application. In another embodiment, said additional C-terminal domain can be linked with a chemical molecule such as a small compound of interest for a defined application.

In a preferred embodiment, said additional domain at the C-terminus of said set of Repeat Variable Dipeptide regions of said core scaffold of the present invention is selected from the group consisting of SEQ ID NO: 295 to 300, SEQ ID NO: 400 and SEQ ID NO: 402 or derivatives thereof.

In another embodiment, said core scaffold of the chimeric protein according to the present invention comprises two additional domains respectively at the N-terminus and at the C-terminus of said set of Repeat Variable Dipeptide regions, as previously described.

In another embodiment, said chimeric protein according to the present invention comprises at least one peptidic linker to fuse a protein domain to said core scaffold previously described. In a preferred embodiment, said peptidic linker is flexible. In another preferred embodiment, said peptidic linker is structured. In a more preferred embodiment, said peptidic linker sequence is selected from the group consisting of NFS1, NFS2, CFS1, RM2, BQY, QGPSG, LGPDGRKA, 1a8h_1, 1dnpA_1, 1d8cA_2, 1ckqA_3, 1sbp_1, 1ev7A_1, 1alo_3, 1amf_1, 1adjA_3, 1fcdC_1, 1al3_2, 1g3p_1, 1acc_3, 1ahjB_1, 1acc_1, 1af7_1, 1heiA_1, 1bia_2, 1igtB_1, 1nfkA_1, 1au7A_1, 1bpoB_1, 1b0pA_2, 1c05A_2, 1gcb_1, 1bt3A_1, 1b3oB_2, 16vpA_6, 1dhx_1, 1b8aA_1, 1qu6A_1 and TAL1 to TAL37 which share SGGSGS stretchs at both N and C-terminal ends and surround a variable region of 3 to 28 amino acids as listed in Table 1 below (SEQ ID NO: 301 to SEQ ID NO: 338 and SEQ ID NO: 134 to SEQ ID NO: 170 and SEQ ID NO: 479 to 485). In a more preferred embodiment, the peptidic linker that can link said core scaffold to said protein domain of the chimeric protein according to the present invention can be selected from the group consisting of TAL1 to TAL37 (SEQ ID NO: 134 to SEQ ID NO: 170). In the scope of the present invention is also encompassed the case where a peptidic linker is not needed to fuse said core scaffold with said protein domain in order to obtain a chimeric protein according to the present invention. In the scope of the present invention is also encompassed the case where more than one linker is needed to fuse several protein domains with said core scaffold according to the present invention. As non-limiting examples, two, three or four linkers can be used in the same chimeric protein according to the present invention. In another embodiment, said peptidic linker contains one or several active domains which allow its deployment under stimulation. As a non-limiting example, said peptidic linker can contain a calmodulin domain that changes its conformation under calcium stimulation; other protein domains changing their conformation under a specific metabolite interaction can be used. As another non-limiting example, such peptidic linker according to the present invention can contain a light sensitive domain wich allows a change in peptidic linker structure from a folded inactive state toward an unfolded active state under light stimulation for example, or reverse. Said peptidic linker can for example contain a first light-sensitive protein switch comprising a phytochrome-chromophore complex and a Phytochrome Interaction Factor (PIF) i.e. a second protein able to reversibly interact with said phytochrome-chromophore complex depending on the light activation/desactivation state. Other examples of active linkers can use small molecules such as Chemical Inducers of Dimerization (CID).

TABLE 1

List of peptidic linkers.

| Name (PDB) | Amino Acids | Length | Size | Sequence | SEQ ID NO |
|---|---|---|---|---|---|
| 1a8h_1 | 285-287 | 3 | 6,636 | NVG | 301 |
| 1dnpA_1 | 130-133 | 4 | 7,422 | DSVI | 302 |
| 1d8cA_2 | 260-263 | 4 | 8,782 | IVEA | 303 |
| 1ckqA_3 | 169-172 | 4 | 9,91 | LEGS | 304 |
| 1sbp_1 | 93-96 | 4 | 10,718 | YTST | 305 |
| 1ev7A_1 | 169-173 | 5 | 11,461 | LQENL | 306 |
| 1alo_3 | 360-364 | 5 | 12,051 | VGRQP | 307 |
| 1amf_1 | 81-85 | 5 | 13,501 | LGNSL | 308 |
| 1adjA_3 | 323-328 | 6 | 14,835 | LPEEKG | 309 |
| 1fcdC_1 | 76-81 | 6 | 14,887 | QTYQPA | 310 |
| 1al3_2 | 265-270 | 6 | 15,485 | FSHSTT | 311 |

TABLE 1-continued

List of peptidic linkers.

| Name (PDB) | Amino Acids | Length | Size | Sequence | SEQ ID NO |
|---|---|---|---|---|---|
| 1g3p_1 | 99-105 | 7 | 17,903 | GYTYINP | 312 |
| 1acc_3 | 216-222 | 7 | 19,729 | LTKYKSS | 313 |
| 1ahjB_1 | 106-113 | 8 | 17,435 | SRPSESEG | 314 |
| 1acc_1 | 154-161 | 8 | 18,776 | PELKQKSS | 315 |
| 1af7_1 | 89-96 | 8 | 22,502 | LTTNLTAF | 316 |
| 1heiA_1 | 322-330 | 9 | 13,534 | TATPPGSVT | 317 |
| 1bia_2 | 268-276 | 9 | 16,089 | LDNFINRPV | 318 |
| 1igtB_1 | 111-119 | 9 | 19,737 | VSSAKTTAP | 319 |
| 1nfkA_1 | 239-248 | 10 | 13,228 | DSKAPNASNL | 320 |
| 1au7A_1 | 103-112 | 10 | 20,486 | KRRTTISIAA | 321 |
| 1bpoB_1 | 138-148 | 11 | 21,645 | PVKMFDRHSSL | 322 |
| 1b0pA_2 | 625-635 | 11 | 26,462 | APAETKAEPMT | 323 |
| 1c05A_2 | 135-148 | 14 | 23,819 | YTRLPERSELPAEI | 324 |
| 1gcb_1 | 57-70 | 14 | 27,39 | VSTDSTPVTNQKSS | 325 |
| 1bt3A_1 | 38-51 | 14 | 28,818 | YKLPAVTTMKVRPA | 326 |
| 1b3oB_2 | 222-236 | 15 | 20,054 | IARTDLKKNRDYPLA | 327 |
| 16vpA_6 | 312-332 | 21 | 23,713 | TEEPGAPLTTPPTLHGNQARA | 328 |
| 1dhx_1 | 81-101 | 21 | 42,703 | ARFTLAVGDNRVLDMASTYFD | 329 |
| 1b8aA_1 | 95-120 | 26 | 31,305 | IVVLNRAETPLPLDPTGKVKAELDTR | 330 |
| 1qu6A_1 | 79-106 | 28 | 51,301 | ILNKEKKAVSPLLLTTTNSSEGLSMGNY | 331 |
| NFS1 | — | 20 | — | GSDITKSKISEKMKGQGPSG | 332 |
| NFS2 | — | 23 | — | GSDITKSKISEKMKGLGPDGRKA | 333 |
| CFS1 | — | 10 | — | SLTKSKISGS | 334 |
| RM2 | — | 32 | — | AAGGSALTAGALSLTAGALSLTAGALSGGGGS | 335 |
| BQY | — | 27 | — | AAGASSVSASGHIAPLSLPSSPPSVGS | 336 |
| QGPSG | — | 5 | — | QGPSG | 337 |
| LGPDGRKA | — | 8 | — | LGPDGRKA | 338 |
| TAL1 | — | 15 | — | SGGSGSNVGSGSGSG | 134 |
| TAL2 | — | 20 | — | SGGSGSLTTNLTAFSGSGSG | 135 |
| TAL3 | — | 22 | — | SGGSGSKRRTTISIAASGSGSG | 136 |
| TAL4 | — | 17 | — | SGGSGSVGRQPSGSGSG | 137 |
| TAL5 | — | 26 | — | SGGSGSYTRLPERSELPAEISGSGSG | 138 |
| TAL6 | — | 38 | — | SGGSGSIVVLNRAETPLPLDPTGKVKAELDTRSGSGSG | 139 |
| TAL7 | — | 21 | — | SGGSGSTATPPGSVTSGSGSG | 140 |
| TAL8 | — | 21 | — | SGGSGSLDNFINRPVSGSGSG | 141 |
| TAL9 | — | 21 | — | SGGSGSVSSAKTTAPSGSGSG | 142 |
| TAL10 | — | 22 | — | SGGSGSDSKAPNASNLSGSGSG | 143 |

TABLE 1-continued

List of peptidic linkers.

| Name (PDB) | Amino Acids | Length | Size | Sequence | SEQ ID NO |
|---|---|---|---|---|---|
| TAL11 | — | 23 | — | SGGSGSPVKMFDRHSSLSGSGSG | 144 |
| TAL12 | — | 23 | — | SGGSGSAPAETKAEPMTSGSGSG | 145 |
| TAL13 | — | 26 | — | SGGSGSVSTDSTPVTNQKSSSGSGSG | 146 |
| TAL14 | — | 16 | — | SGGSGSDSVISGSGSG | 147 |
| TAL15 | — | 33 | — | SGGSGSARFTLAVGDNRVLDMASTYFDSGSGSG | 148 |
| TAL16 | — | 17 | — | SGGSGSLQENLSGSGSG | 149 |
| TAL17 | — | 19 | — | SGGSGSGYTYINPSGSGSG | 150 |
| TAL18 | — | 26 | — | SGGSGSYKLPAVTTMKVRPASGSGSG | 151 |
| TAL19 | — | 16 | — | SGGSGSLEGSSGSGSG | 152 |
| TAL20 | — | 16 | — | SGGSGSIVEASGSGSG | 153 |
| TAL21 | — | 18 | — | SGGSGSQTYQPASGSGSG | 154 |
| TAL22 | — | 27 | — | SGGSGSIARTDLKKNRDYPLASGSGSG | 155 |
| TAL23 | — | 18 | — | SGGSGSLPEEKGSGSGSG | 156 |
| TAL24 | — | 16 | — | SGGSGSYTSTSGSGSG | 157 |
| TAL25 | — | 20 | — | SGGSGSSRPSESEGSGSGSG | 158 |
| TAL26 | — | 17 | — | SGGSGSLGNSLSGSGSG | 159 |
| TAL27 | — | 19 | — | SGGSGSLTKYKSSSGSGSG | 160 |
| TAL28 | — | 33 | — | SGGSGSTEEPGAPLTTPPTLHGNQARASGSGSG | 161 |
| TAL29 | — | 18 | — | SGGSGSFSHSTTSGSGSG | 162 |
| TAL30 | — | 20 | — | SGGSGSPELKQKSSSGSGSG | 163 |
| TAL31 | — | 40 | — | SGGSGSILNKEKKAVSPLLLTTTNSSEGLSMGNYSGSGSG | 164 |
| TAL32 | — | 31 | — | ELAEFHARYADLLLRDLRERPVSLVRGPDSG | 165 |
| TAL33 | — | 31 | — | ELAEFHARPDPLLLRDLRERPVSLVRGLGSG | 166 |
| TAL34 | — | 26 | — | ELAEFHARYADLLLRDLRERSGSGSG | 167 |
| TAL35 | — | 31 | — | DIFDYYAGVAEVMLGHIAGRPATRKRWPNSG | 168 |
| TAL36 | — | 31 | — | DIFDYYAGPDPVMLGHIAGRPATRKRWLGSG | 169 |
| TAL37 | — | 26 | — | DIFDYYAGVAEVMLGHIAGRSGSGSG | 170 |
| Linker A | — | 37 | — | SIVAQLSRPDPALVSFQKLKLACLGGRPALDAVKKGL | 479 |
| Linker B | — | 37 | — | SIVAQLSRPDPAAVSAQKAKAACLGGRPALDAVKKGL | 480 |
| Linker C | — | 37 | — | SIVAQLSRPDPAVVTFHKLKLACLGGRPALDAVKKGL | 481 |
| Linker D | — | 44 | — | SIVAQLSRPDPAQSLAQELSLNESQIKIACLGGRPALDAVKKGL | 482 |
| Linker E | — | 40 | — | SIVAQLSRPDPALQLPPLERLTLDACLGGRPALDAVKKGL | 483 |
| Linker F | — | 38 | — | SIVAQLSRPDPAIHKKFSSIQMACLGGRPALDAVKKGL | 484 |
| Linker G | — | 40 | — | SIVAQLSRPDPAAAAATNDHAVAAACLGGRPALDAVKKGL | 485 |

In another embodiment, said chimeric protein according to the present invention comprises at least one protein domain or catalytic domain to process said nucleic acid target sequence. In another embodiment, the catalytic domain that is capable of processing said nucleic acid target sequence, when fused to said core scaffold according to the present invention, is fused to the N-terminus part of said core scaffold. In another preferred embodiment, said catalytic domain is fused to the C-terminus part of said core scaffold. In another embodiment two catalytic domains are fused to both N-terminus part of said core scaffold and C-terminus of said core scaffold. In the scope of the present invention are encompassed the fusion of one or several catalytic domains to said core scaffold wherein said core scaffold comprises or not an additional domain at its N-terminus and/or at its C-terminus. As previously mentioned, one or several peptidic linkers can be added for said fusions between the different domains of the chimeric protein according to the present invention. By several catalytic domains and several peptidic linkers is intended two or three or four or five as non-limiting examples.

In a preferred embodiment, said catalytic domain has an activity selected from the group consisting of nuclease activity, polymerase activity, kinase activity, phosphatase activity, methylase activity, topoisomerase activity, integrase activity, transposase activity, ligase activity, helicase activity, recombinase activity.

In another preferred embodiment, the catalytic domain fused to the core scaffold of the present invention can be a transcription activator or repressor (i.e. a transcription regulator), or a protein that interacts with or modifies other proteins implicated in DNA processing. Non-limiting examples of DNA processing activities of said chimeric protein of the present invention include, for example, creating or modifying epigenetic regulatory elements, making site-specific insertions, deletions, or repairs in DNA, controlling gene expression, and modifying chromatin structure.

In another more preferred embodiment, said catalytic domain has an endonuclease activity. In another more preferred embodiment, said protein domain has an exonuclease activity. In another more preferred embodiment, said catalytic domain is selected from the group consisting of proteins MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1l, I-BasI, I-BmoI, I-HmuI, I-TevI, 1-TevII, I-TevIII, I-TwoI, R.MspI, R.MvaI, NucA, NucM, Vvn, Vvn_CLS, Staphylococcal nuclease (NUC_STAAU), Staphylococcal nuclease (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva12691, BsrI, BsmI, Nb.BtsCI, Nt.BtsCI, R1.BtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), *E.coli* ExoI, Human TREX2, Mouse TREX1, Human TREX1, Bovine TREX1, Rat TREX1, Human DNA2, Yeast DNA2 (DNA2_YEAST), VP16 and RBBP8, as listed in Table 2 (SEQ ID NO: 339 to SEQ ID NO: 397 and SEQ ID NO: 598-599), a functional mutant, a variant or a derivative thereof. In another embodiment, the chimeric protein according to the present invention comprises a catalytic domain that is a polypeptide comprising an amino acid sequence having at least 80%, preferably at least 90%, more preferably at least 95% identity with any of SEQ ID NO: 339 to 397 and SEQ ID NO: 598-599. In another embodiment, said catalytic domain of the chimeric protein of the invention has an identity with I-TevI (SEQ ID NO: 349). In another embodiment, said catalytic domain has an identity with I-TevI (SEQ ID NO: 349) and is fused to the N-terminal domain of said core scaffold. In another embodiment, said catalytic domain has an identity with I-TevI (SEQ ID NO: 349) and is fused to the C-terminal domain of said core scaffold. In another embodiment, said chimeric protein according to the present invention acts as a monomer wherein two of said monomer respectively bind one nucleic acid sequence adjacent to a nucleic acid target sequence thereby together processing said nucleic target sequence. In another embodiment, said chimeric protein comprises a catalytic domain having identity with I-TevI (SEQ ID NO: 349) and fused to the C-terminal domain of said core scaffold and acts as a monomer wherein two of said monomer respectively bind one nucleic acid sequence adjacent to a nucleic acid target sequence thereby together processing said nucleic target sequence. In this last case, the first and the second monomers have the same amino acid sequence or not. In another embodiment, said chimeric protein comprises a catalytic domain having identity with I-TevI (SEQ ID NO: 349) and fused to the C-terminal domain of said core scaffold acting as a first monomer binding one nucleic acid sequence adjacent to a nucleic acid target sequence and wherein a second chimeric protein monomer comprising I-TevI (SEQ ID NO: 349) or derivatives thereof fused to the N-terminus of said core scaffold acts as a second monomer binding another nucleic acid sequence adjacent to said nucleic acid target sequence, thereby together processing said nucleic target sequence.

In another embodiment, said catalytic domain of the chimeric protein of the invention has an identity with NucA (SEQ ID NO: 355). In another embodiment, said catalytic domain has an identity with NucA (SEQ ID NO: 355) and is fused to the N-terminal domain of said core scaffold. In another embodiment, said catalytic domain has an identity with NucA (SEQ ID NO: 355) and is fused to the C-terminal domain of said core scaffold. In another embodiment, said catalytic domain of the chimeric protein of the invention has an identity with ColE7 (SEQ ID NO: 340). In another embodiment, said catalytic domain has an identity with ColE7 (SEQ ID NO: 340) and is fused to the N-terminal domain of said core scaffold. In another embodiment, said catalytic domain has an identity with ColE7 (SEQ ID NO: 340) and is fused to the C-terminal domain of said core scaffold.

In another embodiment, said catalytic domain of the chimeric protein of the invention has an identity with FokI (SEQ ID NO: 600) and is fused to the N-terminal domain of said core scaffold. In another embodiment, said additional catalytic domain at the N-terminus of said core scaffold comprises an amino acid sequence having at least 80%, preferably at least 90%, more preferably at least 95% identity with Fok-I (SEQ ID NO: 600).

In another more preferred embodiment, any combinations of two catalytic domains selected from the group consisting of proteins MmeI, Colicin-E7 (CEA7_ECOLX), Colicin-E9, APFL, EndA, Endo I (END1_ECOLI), Human Endo G (NUCG_HUMAN), Bovine Endo G (NUCG_BOVIN), R.HinP1I, I-BasI, I-BmoI, I-HmuI, I-TevI, I-TevII, I-TevIII, I-TwoI, R.MspI, R.MvaI, NucA, NucM, Vvn, Vvn_CLS, *Staphylococcal nuclease* (NUC_STAAU), *Staphylococcal nuclease* (NUC_STAHY), Micrococcal nuclease (NUC_SHIFL), Endonuclease yncB, Endodeoxyribonuclease I (ENRN_BPT7), Metnase, Nb.BsrDI, BsrDI A, Nt.BspD6I (R.BspD6I large subunit), ss.BspD6I (R.BspD6I small subunit), R.PleI, MlyI, AlwI, Mva1269I, BsrI, BsmI, Nb.BtsCI, Nt.BtsCI, RtBtsI, R2.BtsI, BbvCI subunit 1, BbvCI subunit 2, Bpu10I alpha subunit, Bpu10I beta subunit, BmrI, BfiI, I-CreI, hExoI (EXO1_HUMAN), Yeast ExoI (EXO1_YEAST), *E.coli* ExoI, Human TREX2, Mouse TREX1, Human TREX1, Bovine TREX1, Rat TREX1, Human DNA2, Yeast DNA2 (DNA2_YEAST), VP16 and RBBP8 as listed in Table 2 (SEQ ID NO: 339 to SEQ ID NO: 397 and SEQ ID NO: 598-599), a functional mutant, a variant or a derivative of these protein domains thereof, and can be fused either to the N-terminus or to the C-terminus or to both N-terminus part and C-terminus part of said core scaffold according to the present invention, respectively. For example, I-HmuI protein domain can be fused to the N-terminus part of said core scaffold and ColE7 protein domain can be fused to the C-terminus part of said core scaffold. In another example, I-TevI protein domain can be fused to the N-terminus part of said core scaffold and ColE7 protein domain can be fused to the C-terminus part of said core scaffold. In the scope of the present invention, it can be envisioned to fuse one protein domain between two core scaffolds according to the invention, each one comprising at least one set of RVDs. In this last case, the number of RVDs for each engineered core TALE scaffold can be the same or not.

In another embodiment, the chimeric protein according to the present invention comprises, catalytic domains respectively fused to the C-terminus and to the N-terminus of said core scaffold and selected from those having identity with:

(i) NucA domain (SEQ ID NO: 355) in N-terminus and NucA domain (SEQ ID NO: 355) in C-terminus;
(ii) ColE7 domain (SEQ ID NO: 340) in N-terminus and ColE7 domain (SEQ ID NO: 340) in C-terminus;
(iii) NucA domain (SEQ ID NO: 355) in N-terminus and ColE7 domain (SEQ ID NO: 340) in C-terminus;
(iv) ColE7 domain (SEQ ID NO: 340) in N-terminus and NucA domain (SEQ ID NO: 355) in C-terminus;
(v) NucA domain (SEQ ID NO: 355) in N-terminus and I-TevI domain (SEQ ID NO: 349) in C-terminus;
(vi) ColE7 domain (SEQ ID NO: 340) in N-terminus and I-TevI domain (SEQ ID NO: 349) in C-terminus;
(vii) FokI domain (SEQ ID NO: 600) in N-terminus and ColE7 domain (SEQ ID NO: 340) in C-terminus;
(viii) FokI domain (SEQ ID NO: 600) in N-terminus and NucA domain (SEQ ID NO: 355) in C-terminus.

In another embodiment, the chimeric protein according to the present invention comprises, catalytic domains respectively fused to the C-terminus and to the N-terminus of said core scaffold and selected from those having identity with:

(i) NucA domain (SEQ ID NO: 355) in N-terminus and I-TevI domain (SEQ ID NO: 349) in C-terminus;
(ii) ColE7 domain (SEQ ID NO: 340) in N-terminus and I-TevI domain (SEQ ID NO: 349) in C-terminus;
(iii) FokI domain (SEQ ID NO: 600) in N-terminus and ColE7 domain (SEQ ID NO: 340) in C-terminus;
(iv) FokI domain (SEQ ID NO: 600) in N-terminus and NucA domain (SEQ ID NO: 355) in C-terminus, said chimeric protein acting as a monomer wherein two of said monomer respectively bind one nucleic acid sequence adjacent to a nucleic acid target sequence thereby together processing said nucleic target sequence.

In another embodiment, said catalytic domain of the chimeric protein of the invention has an identity with FokI (SEQ ID NO: 600) which is fused to the N-terminal domain of said core scaffold, wherein said chimeric protein acts as a monomer and wherein a second monomer binds another nucleic acid sequence adjacent to a nucleic acid target sequence thereby together processing said nucleic acid target sequence. In this case, the first and the second monomers have the same amino acid sequence or not.

In another embodiment, said catalytic domain of the chimeric protein of the invention has an identity with FokI (SEQ ID NO: 600) which is fused to the N-terminal domain of said core scaffold, wherein said chimeric protein acts as a monomer and wherein a second monomer, comprising a catalytic domain having an identity with FokI (SEQ ID NO: 600) which is fused to the C-terminal domain of said core scaffold, binds another nucleic acid sequence adjacent to a nucleic acid target sequence thereby together processing said nucleic acid target sequence.

TABLE 2

List of protein domains for chimeric proteins.

<table>
<tr><th>GENBANK/SWISS-PROT ID</th><th>NAME</th><th>SEQ ID NO</th><th>FASTA SEQUENCE</th></tr>
<tr><td>ACC85607.1</td><td>MmeI</td><td>339</td><td>>gi|186469979|gb|ACC85607.1| Mmel [Methylophilus methylotrophus]<br>MALSWNEIRRKAIEFSKRWEDASDENSQAKPFLIDFFEVFGITNKRVATFEHAVKKFAKAHKEQSRGFVD<br>LFWPGILLIEMKSRGKDLDKAYDQALDYFSGIAERDLPRYVLVCDFQRFRLTDLITKESVEFLLKDLYQN<br>VRSFGFIAGYQTQVIKPQDPINIKAAERMGKLHDTLKLVGYEGHALELYLVRLLFCLFAEDTTIFEKSLF<br>QEYIETKTLEDGSDLAHHINTLFYVLNTPEQKRLKNLDEHLAAFPYINGKLFEEPLPPAQFDKAMREALL<br>DLCSLDWSRISPAIFGSLFQSIMDAKKRRNLGAHYTSEANILKLIKPLFLDELWVEFEINKNNKNKLLAF<br>HKKLRGLTFFDPACGCGNFLVITYRELRLLEIEVLRGLHRGGQQVLDIEHLIQINVDQFFGIEIEEEPAQ<br>IAQVALWLTDHQMNMKISDEIGNYFARIPLKSTPHILNANALQIDWNDVLEAKKCCFILGNPPFVGKSKQ<br>TPGQKADLLSVFGNLKSASDLDLVAAWYPKAAHYIQTNANIRCAFVSTNSITQGEQVSLLWPLLLSLGIK<br>INFAHRTFSWTNEASGVAAVHCVIIGFGLKDSDEKIIYEYESINGEPLAIKAKNINPYLRDGVDVIACKR<br>QQPISKLPSMRYGNKPTDDGNFLFTDEEKNQFITNEPSSEKYFRRFVGGDEFINNTSRWCLWLDGADISE<br>IRAMPLVLARIKKVQEFRLKSSAKPTRQSASTPMKFFYISQPDTDYLLIPETSSENRQFIPIGFVDRNVI<br>SSNATYHIPSAEPLIFGLLSSTMHNCWMRNVGGRLESRYRYSASLVYNTFPWIQPNEKQSKAIEEAAFAI<br>LKARSNYPNESLAGLYDPKTMPSELLKAHQKLDKAVDSVYGFKGPNTEIARIAFLFETYQKMTSLLPPEK<br>EIKKSKGKN</td></tr>
<tr><td>Q47112.2</td><td>Colicin-E7<br>(CEA7_ECOLX)</td><td>340</td><td>>gi|12644448|sp|Q47112.2| CEA7_ECOLX RecName: Full = Colicin-E7<br>MSGGDGRGHNSGAHNTGGNINGGPTGLGGNGGASDGSGWSSENNPWGGGSGSGVHWGGGSGHGNGGG<br>NSN<br>SGGGSNSSVAAPMAFGFPALAAPGAGTLGISVSGEALSAAIADIFAALKGPFKFSAWGIALYGILPSEIA<br>KDDPNMMSKIVTSLPAETVTNVQVSTLPLDQATVSVTKRVTDVVKDTRQHIAVVAGVPMSVPVVNAKPTR<br>TPGVFHASFPGVPSLTVSTVKGLPVSTTLPRGITEDKGRTAVPAGFTEGGGSHEAVIRFPKESGQKPVYV<br>SVTDVLTPAQVKQRQDEEKRLQQEWNDAHPVEVAERNYEQARAELNQANKDVARNQERQAKAVQVYNSRK<br>SELDAANKTLADAKAEIKQFERFAREPMAAGHRMWQMAGLKAQRAQTDVNNKKAAFDAAAKEKSDADVAL<br>SSALERRKQKENKEKDAKAKLDKESKRNKPGKATGKGKPVNNKWLNNAGKDLGSPVPDRIANKLRDKEFK<br>SFDDERKKFWEEVSKDPELSKQESRNNNDRMKVGKAPKTRTQDVSGKRTSFELHHEKPISQNGGVYDMDN<br>ISVVTPKRHIDIHRGK</td></tr>
<tr><td>CAA38134.1</td><td>EndA</td><td>341</td><td>>gi|47374|emb|CAA38134.1| EndA [Streptococcus pneumoniae]<br>MNKKTRQTLIGLLVLLLLSTGSYYIKQMPSAPNSPKTNLSQKKQASEAPSQALAESVLTDAVKSQIKGSL<br>EWNGSGAFIVNGNKTNLDAKVSSKPYADNKTKTVGKETVPTVANALLSKATRQYKNRKETGNGSTSWTPP<br>GWHQVKNLKGSYTHAVDRGHLLGYALIGGLDGFDASTSNPKNIAVQTAWANQAQAEYSTGQNYYESKVRK<br>ALDQNKRVRYRVTLYYASNEDLVPSASQIEAKSSDGELEFNVLVPNVQKGLQLDYRTGEVTVTQ</td></tr>
<tr><td>P25736.1</td><td>Endo I<br>(END1_ECOLI)</td><td>342</td><td>>gi|119325|sp|P25736.1| END1_ECOLI RecName: Full = Endonuclease-1; AltName:<br>Full = Endonuclease I; Short = Endo I; Flags: Precursor<br>MYRYLSIAAVVLSAAFSGPALAEGINSFSQAKAAAVKVHADAPGTFYCGCKINWQGKKGVVDLQSCGYQV<br>RKNENRASRVEWEHVVPAWQFGHQRQCWQDGGRKNCAKDPVYRKMESDMHNLQPSVGEVNGDRGNFMY<br>SQ<br>WNGGEGQYGQCAMKVDEKEKAAEPPARARGAIARTYFYMRDQYNLTLSRQQTQLFNAWNKMYPVTDWECE<br>RDERIAKVQGNHNPYVQRACQARKS</td></tr>
<tr><td>Q14249.4</td><td>Human Endo G<br>(NUCG_HUMAN)</td><td>343</td><td>>gi|317373579|sp|Q14249.4| NUCG_HUMAN RecName: Full = Endonuclease G, mitochondrial;<br>Short = Endo G; Flags: Precursor<br>MRALRAGLTLASGAGLGAVVEGWRRRREDARAAPGLLGRLPVLPVAAAAELPPVPGGPRGPGELAKYGLP</td></tr>
</table>

TABLE 2-continued

<table>
<tr><td colspan="4">List of protein domains for chimeric proteins.</td></tr>
<tr><th>GENBANK/SWISS-PROT ID</th><th>NAME</th><th>SEQ ID NO</th><th>FASTA SEQUENCE</th></tr>
<tr><td></td><td></td><td></td><td>GLAQLKSRESYVLCYDPRTRGALWVVEQLRPERLRGDGDRRECDFREDDSVHAYHRATNADYRGSGFDRG<br>HLAAAANHRWSQKAMDDTFYLSNVAPQVPHLNQNAWNNLEKYSRSLTRSYQNVYVCTGPLFLPRTEADGK<br>SYVKYQVIGKNHVAVPTHFFKVLILEAAGGQIELRTYVMPNAPVDEAIPLERFLVPIESIERASGLLFVP<br>NILARAGSLKAITAGSK</td></tr>
<tr><td>P38447.1</td><td>Bovine Endo G<br>(NUCG_BOVIN)</td><td>344</td><td>>gi|585596|sp|P38447.1| NUCG_BOVIN RecName: Full = Endonuclease G, mitochondrial;<br>Short = Endo G; Flags: Precursor<br>MQLLRAGLTLALGAGLGAAAESWWRQRADARATPGLLSRLPVLPVAAAAGLPAVPGAPAGGGPGELAKYG<br>LPGVAQLKSRASYVLCYDPRTRGALWVVEQLRPEGLRGDGNRSSCDFHEDDSVHAYHRATNADYRGSGFD<br>RGHLAAAANHRWSQKAMDDTFYLSNVAPQVPHLNQNAWNNLEKYSRSLTRTYQNVYVCTGPLFLPRTEAD<br>GKSYVKYQVIGKNHVAVPTHFFKVLILEAAGGQIELRSYVMPNAPVDEAIPLEHFLVPIESIERASGLLF<br>VPNILARAGSLKAITAGSK</td></tr>
<tr><td>AAW33811.1</td><td>R.HinP1I</td><td>345</td><td>>gi|57116674|gb|AAW33811.1| R.HinP1I restriction endonuclease [Haemophilus influenzae]<br>MNLVELGSKTAKDGEKNEKDIADRFENWKENSEAQDWLVTMGHNLDEIKSVKAVVLSGYKSDINVQVLVF<br>YKDALDIHNIQVKLVSNKRGENQIDKHWLARYQEMWKFDDNLLRILRHFTGELPPYHSNTKDKRRMFMTE<br>FSQEEQNIVLNWLEKNRVLVLTDILRGRGDFAAEWVLVAQKVSNNARWILRNINEVLQHYGSGDISLSPR<br>GSINFGRVTIQRKGGDNGRETANMLQFKIDPTELFDI</td></tr>
<tr><td>AAO93095.1</td><td>I-BasI</td><td>346</td><td>>gi|29838473|gb|AAO93095.1| I-BasI [Bacillus phage Bastille]<br>MFQEEWKDVTGFEDYYEVSNKGRVASKRTGVIMAQYKINSGYLCIKFTVNKKRTSHLVHRLVAREFCEGY<br>SPELDVNHKDTDRMNNNYDNLEWLTRADNLKDVRERGKLNTHTAREALAKVSKKAVDVYTKDGSEYIATY<br>PSATEAAEALGVQGAKISTVCHGKRQHTGGYHEKENSSVDPNRSVSKK</td></tr>
<tr><td>AAK09365.1</td><td>I-BmoI</td><td>347</td><td>>gi|12958590|gb|AAK09365.1| AF321518_2 intron encoded I-BmoI [Bacillus mojavensis]<br>MKSGVYKITNKNTGKFYIGSSEDCESRLKVHFRNLKNNRHINRYLNNSFNKHGEQVFIGEVIHILPIEEA<br>IAKEQWYIDNEYEEMYNISKSAYHGGDLTSYHPDKRNIILKRADSLKKVYLKMTSEEKAKRWQCVQGENN<br>PMFGRKHTETTKLKISNHNKLYYSTHKNPFKGKKHSEESKTKLSEYASQRVGEKNPFYGKTHSDEFKTYM<br>SKKFKGRKPKNSRPVIIDGTEYESATEASRQLNVVPATILHRIKSKNEIMGYFYK</td></tr>
<tr><td>P34081.1</td><td>I-HmuI</td><td>348</td><td>>gi|465641|sp|P34081.1| HMUI_BPSP1 RecName: Full = DNA endonuclease I-HmuI; AltName:<br>Full = HNH homing endonuclease I-HmuI<br>MEWKDIKGYEGHYQVSNTGEVYSIKSGKTLKHQIPKDGYHRIGLFKGGKGKTFQVHRLVAIHFCEGYEEG<br>LVVDHKDGNKDNNLSTNLRWVTQKINVENQMSRGTLNVSKAQQIAKIKNQKPIIVISPDGIEKEYPSTKC<br>ACEELGLTRGKVTDVLKGHRIHHKGYTERYKLNG</td></tr>
<tr><td>P13299.2</td><td>I-TevI</td><td>349</td><td>>gi|6094464|sp|P13299.2| TEV1_BPT4 RecName: Full = Intron-associated endonuclease 1; AltName:<br>Full = I-TevI; AltName: Full = IRF protein<br>MKSGIYQIKNTLNNKVYVGSAKDFEKRWKRHFKDLEKGCHSSIKLQRSENKHGNVFECSILEEIPYEKDL<br>IIERENFWIKELNSKINGYNIADATFGDTCSTHPLKEEIIKKRSETVKAKMLKLGPDGRKALYSKPGSKN<br>GRWNPETHKFCKCGVRIQTSAYTCSKCRNRSGENNSFENHKHSDITKSKISEKMKGKKPSNIKKISCDGV<br>IFDCAADAARHFKISSGLVTYRVKSDKWNWFYINA</td></tr>
<tr><td>P07072.2</td><td>I-TevII</td><td>350</td><td>>gi|20141823|sp|P07072.2| TEV2_BPT4 RecName: Full = Intron-associated endonuclease 2;<br>AltName: Full = I-TevII<br>MKWKLRKSLKIANSVAFTYMVRFPDKSFYIGFKKFKTIYGKDINWKEYNSSSKLVKEKLKDYKAKWIILQ<br>VFDSYESALKHEEMLIRKYFNNEFILNKSIGGYKFNKYPDSEEHKQKLSNAHKGKILSLKHKDKIREKLI</td></tr>
</table>

TABLE 2-continued

<table>
<tr><th colspan="4">List of protein domains for chimeric proteins.</th></tr>
<tr><th>GENBANK/SWISS-PROT ID</th><th>NAME</th><th>SEQ ID NO</th><th>FASTA SEQUENCE</th></tr>
<tr><td></td><td></td><td></td><td>EHYKNNSRSEAHVKNNIGSRTAKKTVSIALKSGNKFRSFKSAAKFLKCSEEQVSNHPNVIDIKITINPVP<br>EYVKINDNIYKSFVDAAKDLKLHPSRIKDLCLDDNYPNYIVSYKRVEK</td></tr>
<tr><td>Q38419.1</td><td>I-TevIII</td><td>351</td><td>>gi|11387192|sp|Q38419.1| TEV3_BPR03 RecName: Full = Intron-associated endonuclease 3; AltName: Full = I-TevIII<br>MNYRKIWIDANGPIPKDSDGRTDEIHHKDGNRENNDLDNLMCLSIQEHYDIHLAQKDYQACHAIKLRMKY<br>SPEEISELASKAAKSREIQIFNIPEVRAKNIASIKSKIENGTFHLLDGEIORKSNLNRVALGIHNFQQAE<br>HIAKVKERNIAAIKEGTHVFCGGKMQSETQSKRVNDGSHHFLSEDHKKRTSAKTLEMVKNGTHPAQKEIT<br>CDFCGHIGKGPGFYLKHNDRCKLNPNRIQLNCPYCDKKIDLSPSTYKRWHGDNCKARFND</td></tr>
<tr><td>AAM00817.1</td><td>I-TwoI</td><td>352</td><td>>gi|19881200|gb|AAM00817.1| AF485080_2 HNH endonuclease I-TwoI [Staphylococcus phage Twort]<br>MEELWKEIPGFNSYMISNKGQVYSRKRNKILALRTDKNGYKRISIFNNEGKRILLGVHKLVLLGFKGINT<br>EKPIPHHKNNIKDDNRLENLEWVIVSENTKHAYDIGALKSPRRVTCTLYYKGEPLSCYDSLFDLAKALKV<br>SRSVIESPRNGLVLSTFEVKREPTIQGLPLNKEIFEHSLIKGLGNPPLKVYNEDETYYFLTLMDISKYFN<br>ESYSKVQRGYYKGKWKSYIIEHIDFYEYYKQTH</td></tr>
<tr><td>P11405.1</td><td>R.MspI</td><td>353</td><td>>gi|135239|sp|P11405.1| T2M1_MORSP RecName: Full = Type-2 restriction enzyme MspI; Short = R.MspI; AltName: Full = Endonuclease MspI; AltName: Full = Type II restriction enzyme MspI<br>MRTELLSKLYDDFGIDQLPHTQHGVTSDRLGKLYEKYILDIFKDIESLKKYNTNAFPQEKDISSKLLKAL<br>NLDLDNIIDVSSSDTDLGRTIAGGSPKTDATIRFTFHNQSSRLVPLNIKHSSKKKVSIAEYDVETICTGV<br>GISDGELKELIRKHQNDQSAKLFTPVQKQRLTELLEPYRERFIRWCVTLRAEKSEGNILHPDLLIRFQVI<br>DREYVDVTIKNIDDYVSDRIAEGSKARKPGFGTGLNWTYASGSKAKKMQFKG</td></tr>
<tr><td>R.MvaI</td><td>R.MvaI</td><td>354</td><td>>gi|119392963|gb|AAM03024.2| AF472612_1 R.MvaI [Kocuria varians]<br>MSEYLNLLKEAIQNVVDGGWHETKRKGNTGIGKTFEDLLEKEEDNLDAPDFHDIEIKTHETAAKSLLTLF<br>TKSPTNPRGANTMLRNRYGKKDEYGNNILHQTVSGNRKTNSNSYNYDFKIDIDWESQVVRLEVFDKQDIM<br>IDNSVYWSFDSLQNQLDKKLKYIAVISAESKIENEKKYYKYNSANLFTDLTVQSLCRGIENGDIKVDIRI<br>GAYHSGKKKGKTHDHGTAFRINMEKLLEYGEVKVIV</td></tr>
<tr><td>CAA45962.1</td><td>NucA</td><td>355</td><td>>gi|39041|emb|CAA45962.1| NucA [Nostoc sp. PCC 7120]<br>MGICGKLGVAALVALIVGCSPVQSQVPPLTELSPSISVHLLLGNPSGATPTKLTPDNYLMVKNQYALSYN<br>NSKGTANWVAWQLNSSWLGNAERQDNFRPDKTLPAGWVRVTPSMYSGSGYDRGHIAPSADRTKTTEDNAA<br>TFLMTNMMPQTPDNNRNTWGNLEDYCRELVSQGKELYIVAGPNGSLGKPLKGKVTVPKSTWKIVVVLDSP<br>GSGLEGITANTRVIAVNIPNDPELNNDWRAYKVSVDELESLTGYDFLSNVSPNIQTSIESKVDN</td></tr>
<tr><td>P37994.2</td><td>NucM</td><td>356</td><td>>gi|313104150|SP|P37994.2| NUCM_DICD3 RecName: Full = Nuclease nucM; Flags: Precursor<br>MLRNLVIFAVLGAGITTLAAAGQDINNFTQAKAAAAKIHQDAPGTFYCGCKINWQGKKGTPDLASCGYQV<br>RKDANRASRIEWEHVVPAWQFGHQRQCWQDGGRKNCTKDDVYRQIETDLHNLQPAIGEVNGDRGNFMYSQ<br>WNGGERQYGQCEMKIDFKSQLAEPPERARGAIARTYFYMRDRYNLNLSRQQTQLFDAWNKQYPATTWECT<br>REKRIAAVQGNHNPYVQQACQP</td></tr>
<tr><td>AAF19759.1</td><td>Vvn</td><td>357</td><td>>gi|6635279|gb|AAF19759.1| AF063303_1 nuclease precursor Vvn [Vibrio vulnificus]<br>MKRLFIFIASFTAFAIQAAPPSSFSAAKQQAVKIYQDHPISFYCGCDIEWQGKKGIPNLETCGYQVRKQQ<br>TRASRIEWEHVVPAWQFGHHRQCWQKGGRKNCSKNDQQFRLMEADLHNLTPAIGEVNGDRSNFNFSQWNG<br>VDGVSYGRCEMQVNFKQRKVMPQTELRGSIARTYLYMSQEYGFQLSKQQQQLMQAWNKSYPVDEWECTRD<br>DRIAKIQGNHNPFVQQSCQTQ</td></tr>
</table>

TABLE 2-continued

List of protein domains for chimeric proteins.

| GENBANK/SWISS-PROT ID | NAME | SEQ ID NO | FASTA SEQUENCE |
|---|---|---|---|
| AAF19759.1 (reference) | Vvn_CLS | 358 | >Vvn_CLS (variant of AAF19759.1)<br>MASGAPPSSFSAAKQQAVKIYQDHPISFYCGCDIEWQGKKGIPNLETCGYQVRKQQTRASRIEWEHVVPA<br>WQFGHHRQCWQKGGRKNCSKNDQQFRLMEADLHNLTPAIGEVNGDRSNFNFSQWNGVDGVSYGRCEMQV<br>N<br>FKQRKVMPPDRARGSIARTYLYMSQEYGFQLSKQQQQLMQAWNKSYPVDEWECTRDDRIAKIQGNHNPFV<br>QQSCQTQGSSAD |
| P00644.1 | Staphylococcal nuclease (NUC_STAAU) | 359 | >gi\|128852\|sp\|P00644.1\| NUC_STAAU RecName: Full = Thermonuclease; Short = TNase; AltName: Full = Micrococcal nuclease; AltName: Full = Staphylococcal nuclease; Contains: RecName: Full = Nuclease B; Contains: RecName: Full = Nuclease A; Flags: Precursor<br>MLVMTEYLLSAGICMAIVSILLIGMAISNVSKGQYAKRFFFFATSCLVLTLVVVSSLSSSANASQTDNGV<br>NRSGSEDPTVYSATSTKKLHKEPATLIKAIDGDTVKLMYKGQPMTFRILLVDTPETKHPKKGVEKYGPEA<br>SAFTKKMVENAKKIEVEFDKGQRTDKYGRGLAYIYADGKMVNEALVRQGLAKVAYVYKPNNTHEQHLRKS<br>EAQAKKEKLNIWSEDNADSGQ |
| P43270.1 | Staphylococcal nuclease (NUC_STAHY) | 360 | >gi\|1171859\|sP\|P43270.1\| NUC_STAHY RecName: Full = Thermonuclease; Short = TNase; AltName: Full = Micrococcal nuclease; AltName: Full = Staphylococcal nuclease; Flags: Precursor<br>MKKITTGLIIVVAAIIVLSIQFMTESGPFKSAGLSNANEQTYKVIRVIDGDTIIVDKDGKQQNLRMIGVD<br>TPETVKPNTPVQPYGKEASDFTKRHLTNQKVRLEYDKQEKDRYGRTLAYVWLGKEMFNEKLAKEGLARAK<br>FYRPNYKYQERIEQAQKQAQKLKKNIWSN |
| P29769.1 | Micrococcal nuclease (NUC_SHIFL) | 361 | >gi\|266681\|sp\|P29769.1\| NUC_SHIFL RecName: Full = Micrococcal nuclease; Flags: Precursor<br>MKSALAALRAVAAAVVLIVSVPAWADFRGEVVRILDGDTIDVLVNRQTIRVRLADIDAPESGQAFGSRAR<br>QRLADLTFRQEVQVTEKEVDRYGRTLGVVYAPLQYPGGQTQLTNINAIMVQEGMAWAYRYYGKPTDAQMY<br>EYEKEARRQRLGLWSDPNAQEPWKWRRASKNATN |
| P94492.1 | Endonuclease yncB | 362 | >gi\|81345826\|sp\|\| YNCB_BACSU RecName: Full = Endonuclease yncB; Flags: Precursor<br>MKKILISMIAIVLSITLAACGSNHAAKNHSDSNGTEQVSQDTHSNEYNQTEQKAGTPHSKNQKKLVNVTL<br>DRAIDGDTIKVIYNGKKDTVRYLLVDTPETKKPNSCVQPYGEDASKRNKELVNSGKLQLEFDKGDRRDKY<br>GRLLAYVYVDGKSVQETLLKEGLARVAYVYEPNTKYIDQFRLDEQEAKSDKLSIWSKSGYVTNRGFNGCV<br>K |
| P00641.1 | Endodeoxyribo nuclease I (ENRN_BPT7) | 363 | >gi\|119370\|sp\|P00641.1\| ENRN_BPT7 RecName: Full = Endodeoxyribonuclease 1; AltName: Full = Endodeoxyribonuclease I; Short = Endonuclease<br>MAGYGAKGIRKVGAFRSGLEDKVSKQLESKGIKFEYEEWKVPYVIPASNHTYTPDFLLPNGIFVETKGLW<br>ESDDRKKHLLIREQHPELDIRIVFSSSRTKLYKGSPTSYGEFCEKHGIKFADKL1PAEWIKEPKKEVPFD<br>RLKRKGGKK |
| Q53H47.1 | Metnase | 364 | >gi\|74740552\|sp\|Q53H47.1\| SETMR_HUMAN RecName: Full = Histone-lysine N-methyltransferase SETMAR; AltName: Full = SET domain and mariner transposase fusion gene-containing protein; Short = HsMarI; Short = Metnase; Includes: RecName: Full = Histone-lysine N methyltransferase; Includes: RecName: Full = Mariner transposase HsmarI<br>MAEFKEKPEAPTEQLDVACGQENLPVGAWPPGAAPAPFQYTPDHVVGPGADIDPTQITFPGCICVKTPCL<br>PGTCSCLRHGENYDDNSCLRDIGSGGKYAEPVFECNVLCRCSDHCRNRVVQKGLQFHFQVFKTHKKGWGL<br>RTLEFIPKGRFVCEYAGEVLGFSEVQRRIHLQTKSDSNYIIAIREHVYNGQVMETFVDPTYIGNIGRFLN<br>HSCEPNLLMIPVRIDSMVPKLALFAAKDIVPEEELSYDYSGRYLNLTVSEDKERLDHGKLRKPCYCGAKS |

TABLE 2-continued

<table>
<tr><th colspan="4">List of protein domains for chimeric proteins.</th></tr>
<tr><th>GENBANK/SWISS-PROT ID</th><th>NAME</th><th>SEQ ID NO</th><th>FASTA SEQUENCE</th></tr>
<tr><td></td><td></td><td></td><td>CTAFLPFDSSLYCPVEKSNISCGNEKEPSMCGSAPSVFPSCKRLTLETMKMMLDKKQIRAIFLFEFKMGR<br>KAAETTRNINNAFGPGTANERTVQWWFKKFCKGDESLEDEERSGRPSEVDNDQLRAIIEADPLTTTREVA<br>EELNVNHSTVVRHLKQIGKVKKLDKWVPHELTENQKNRRFEVSSSLILRNHNEPFLDRIVTCDEKWILYD<br>NRRRSAQWLDQEEAPKHFPKPILHPKKVMVTIWWSAAGLIHYSFLNPGETITSEKYAQEIDEMNQKLQRL<br>QLALVNRKGPILLHDNARPHVAQPTLQKLNELGYEVLPHPPYSPDLLPTNYHVFKHLNNFLQGKRFHNQQ<br>DAENAFQEFVESQSTDFYATGINQLISRWQKCVDCNGSYFD</td></tr>
<tr><td>ABD15132.1</td><td>Nb.BsrDI</td><td>365</td><td>>gi|86757493|gb|ABD15132.1| Nb.BsrDI [Geobacillus stearothermophilus]<br>MTEYDLHLYADSFHEGHWCCENLAKIAQSDGGKHQIDYLQGFIPRHSLIFSDLIINITVFGSYKSWKHLP<br>KQIKDLLFWGKPDFIAYDPKNDKILFAVEETGAVPTGNQALQRCERIYGSARKQIPFWYLLSEFGQHKDG<br>GTRRDSIWPTIMGLKLTQLVKTPSIILHYSDINNPEDYNSGNGLKFLFKSLLQIIINYCTLKNPLKGMLE<br>LLSIQYENMLEFIKSQWKEQIDFLPGEEILNTKTKELARMYASLAIGQTVKIPEELFNWPRTDKVNFKSP<br>QGLIKYDELCYQLEKAVGSKKAYCLSNNAGAKPQKLESLKEWINSQKKLFDKAPKLTPPAEFNMKLDAFP<br>VTSNNNYYVTTSKNILYLFDYWKDLRIAIETAFPRLKGKLPTDIDEKPALIYICNSVKPGRLFGDPFTGQ<br>LSAFSTIFGKKNIDMPRIVVAYYPHQIYSQALPKNNKSNKGITLKKELTDFLIFHGGVVVKLNEGKAY</td></tr>
<tr><td>ABD15133.1</td><td>BsrDI A</td><td>366</td><td>>gi|86757494|gb|ABD15133.1| BsrDI A [Geobacillus stearothermophilus]<br>MTDYRYSFELSEEIARWAFEIKTKNTDWFVAFSNPTAGPWKRVMAIDKASNREGEVHRFGREDERPDIIL<br>VNDNISLILILEAKEKLNQLISKSQVDKSVDVFLTLSSILKEKSDNNYWGDRTKYINVLGILWGSEQETS<br>QKDIDNAFRVYRDSLVKNLKEINPTPTNICTDILVGVESIKNKKEEISIKIHVSNIYAEIYPKFTGKHLL<br>EKLAVLN</td></tr>
<tr><td>ABN42182.1</td><td>Nt.BspD6I (R.BspD6I large subunit)</td><td>367</td><td>>gi|125396996|gb|ABN42182.1| heterodimeric restriction endonuclease R.BspD6I large subunit [Bacillus sp. D6]<br>MAKKVNWYVSCSPRSPEKIQPELKVLANFEGSYWKGVKGYKAQEAFAKELAALPQFLGTTYKKEAAFSTR<br>DRVAPMKTYGFVFVDEEGYLRITEAGKMLANNRRPKDVFLKQLVKWQYPSFQHKGKEYPEEEWSINPLVF<br>VLSLLKKVGGLSKLDIAMFCLTATNNNQVDEIAEEIMQFRNEREKIKGQNKKLEFTENYFFKRFEKIYGN<br>VGKIREGKSDSSHKSKIETKMRNARDVADATTRYFRYTGLFVARGNQLVLNPEKSDLIDEIISSSKVVKN<br>YTRVEEFHEYYGNPSLPQFSFETKEQLLDLAHRIRDENTRLAEQLVEHFPNVKVEIQVLEDIYNSLNKKV<br>DVETLKDVIYHAKELQLELKKKKLQADFNDPRQLEEVIDLLEVYHEKKNVIEEKIKARF1ANKNTVFEWL<br>TWNGFIILGNALEYKNNFVIDEELQPVTHAAGNQPDMEIIYEDFIVLGEVTTSKGATQFKMESEPVTRHY<br>LNKKKELEKQGVEKELYCLFIAPEINKNTFEEFMKYNIVQNTRIIPLSLKQFNMLLMVQKKLIEKGRRLS<br>SYDIKNLMVSLYRTTIECERKYTQIKAGLEETLNNWVVDKEVRF</td></tr>
<tr><td>ABN42183.1</td><td>ss.BspD6I (R.BspD6I small subunit)</td><td>368</td><td>>gi|125396997|gb|ABN42183.1| heterodimeric restriction endonuclease R.BspD6I small subunit [Bacillus sp. D6]<br>MQDILDFYEEVEKTINPPNYFEWNTYRVFKKLGSYKNLVPNFKLDDSGHPIGNAIPGVEDILVEYEHFSI<br>LIECSLTIGEKQLDYEGDSVVRHLQEYKKKGIEAYTLFLGKSIDLSFARHIGFNKESEPVIPLTVDQFKK<br>LVTQLKGDGEHENPNKLKEILIKLLRSDLGYDQAEEWLTFIEYNLK</td></tr>
<tr><td>AAK27215.1</td><td>R.PleI</td><td>369</td><td>>gi|13448813|gb|AAK27215.1| AF355461_2 restriction endonuclease R.PleI [Paucimonas lemoignei]<br>MAKPIDSKVLFITTSPRTPEKMVPEIELLDKNFNGDVWNKDTQTAFMKILKEESFFDGEGKNDPAFSARD<br>RINRAPKSLGFVILTPKLSLTDAGVELIKAKRKDDIFLRQMLKFQLPSPYHKLSDKAALFYVKPYLEIFR<br>LVRHEGSLTEDELMIEGLQIIDFRIFNQIVDKIEDFRVGKIENKGRYKTYKKERFEEELGKIYKDELFGL<br>TEASAKTLITKKGNNMRDYADACVRYLRATGMVNVSYQGKSLSIVQEKKEEVDFFLKNTEREPCFINDEA<br>SYVSYLGNPNYPKLFVDDVDRIKKKLRFDFKKTNKVNALTLPELKEELENEILSRKENILKSQISDIKNF</td></tr>
</table>

TABLE 2-continued

List of protein domains for chimeric proteins.

| GENBANK/SWISS-PROT ID | NAME | SEQ ID NO | FASTA SEQUENCE |
|---|---|---|---|
| | | | KLYEDIQEVFEKIENDRTLSDAPLMLEWNTWRAMTMLDGGEIKANLKEDINGSPMSTAIGNMPDIVCEYD<br>DFQLSVEVTMASGQKQYEMEGEPVSRHLGKLKKSSEKPVYCLFIAPKINPSSVAHFFMSHKVDIEYYGGK<br>SLIIPLELSVERKMIEDTFKASYIPKSDNVHKLEKNFASIADEAGNEKVWYEGVKRTAMNWLSLS |
| AAK39546.1 | MlyI | 370 | >gi\|13786046\|gb\|AAK39546.1\| AF355462_2 MlyIR [*Micrococcus lylae*]<br>MASLSKTKHLFGETSPRTIEKIIPELDILSQQFSGKVWGENQINFFDAIFNSINYEGTTYPQDPALAARD<br>RITRAPKALGFIQLKPVIQLTKAGNQLVNQKRLPELFTKQLLKFQLPSPYHTQSPTVNFNVRPYLELLRL<br>INELGSISKTEIALFFLQLVNYNKFDEIKNKILKFRETRKNNRSVSWKTYVSQEFEKQISIIFADEVTAK<br>NERTRESSDESFKKEVKTKEGNMKDYADAFFRYIRGTQLVTIDKNLHLKISSLKQDSVDFLLKNTDRNAL<br>NLSLMEYENYLFDPDQLIVLEDNSGLINSKIKQLDDSINVESLKIDDAKDLLNDLEIQRKAKTIEDTVNH<br>LKLRSDIEDILDVFAKIKKRDVPDVPLFLEWNIWRAFAALNHTQAIEGNFIVDLDGMPLNTAPGKKPDIE<br>INYGSFSCIVEVTMSSGETQFNMEGSSVPRHYGDLVRKVDHDAYCIFIAPKVAPGTKAHFFNLNRLSTKH<br>YGGKTKIIPMSLDDFICFLQVGITHNFQDINKLKNWLDNLINFNLESEDEEIWFEEIISKISTWAI |
| YP_004134094.1 | AlwI | 371 | >gi\|319768594\|ref\|YP_004134094.1\| restriction endonuclease, type II, AlwI [*Geobacillus* sp.<br>Y412MC52]<br>MNKKNTRKVWFITRPERDPRFHQEALLALQKATDDFRLKWAGNREVHKRYEEELANMGIKRNNVSHDGSG<br>GRTWMAMLKTESYCYVDDDGYIRLTKVGEKLIQGEKVYENTRKQVLTLQYPNAYFLEPGFRPKEDEGFRI<br>RPVLFLIKLANDERLDFYVTKEEITYFAMTAQKDSQLDEIVHKILAFRKAGPREREEMKQDIAAKFDHRE<br>RSDKGARDEYEAHSDVAHTFMLISDYTGLVEYIRGKALKGDSSKINEIKQEIAEIEKRYPENTRYMISLE<br>RMAENSGLDVDSYKASRYGNIKPAANSSKLRAKAERILAQFPSIESMSKEEIAGALQKYLSPRDIEKVIH<br>EIVENKDDFEGINSDFVETYLNEKDNLAFEDKTGQIFSALGFDVAMRPKAKNGERTEIEIIARYGGSKFG<br>IIDAKNYAGKEPLSSSLVSHMASEYIPNYTGYEGKELTFEGYVTANDFSGERNLEKISDKAKRITGNPIS<br>GFLVTARTLLGFLDYCIENDVPLEDRAELFVKAVKNKGYKSLEALLRELKETI |
| AAY97906.1 | Mva1269I | 372 | >gi\|68480350\|gb\|AAY97906.1\|Mva1269\| restriction endonuclease [*Kocuria varians*]<br>MYLNTAVFNIYGDNIVECSRAFHYILEGFKLANISITQEYDLQNITTPKFCIYTDKFRYIFIFIPGTSAS<br>RWNKDIYKELVLNNGGPLKEGADAIITRIFSEDSELVLASMEFSAALPAGNNTWQRSGRAYSLTAANIPY<br>FYIVQLGGKEIKKGKDGKSDKFATRLPNPALSLSFTLNTIKKPAPSLIVYDQAPEADSAISDLYSNCYGI<br>DDFSLYLFKLITEENNLHELKNIYNKNVEFLQLRSVDEKGKNFSGKDYKYIFEHKDPYKGLTEVVKERKI<br>PWKKKTATKTFENFPLRNQAPIFRLIDFLSTKSYGIVSKDSLPLTFIPSEHRVEVANYICNQLYIDKVSD<br>EFVKWIYKKEDLAICIINGFKPGGDDSRPDRGLPPFTKMLTNLDILTLMFGPAPPTQWDYLDSDPEKLNK<br>INGLWQSIFAFSDAILVDSSTRDNNKFVYNAYLKEHWVVQREKKESNTPISYFPKSVGEHDVDTSLHILF<br>TYIGKHFESACNPPGGDWSGVSLLKNNIEYRWTSMYRVSQDGTKRPDHIYQLVYNSTDTLLLIESKGIKN<br>DLLKSKEANVGIGMINYLKNLMARDYTAVKKDGEWKNIHGQMTLDKFLTFSAVAYLFTTDFDNEYTSAAE<br>LLVHSNTQLAFALEIKEKNSVMHIFTANTVAYNFAEYLLETMRNSFILPLKIYKPI |
| ADR72996.1 | BsrI | 373 | >gi\|313667100\|gb\|ADR72996.1\| BsrI [Geobacillus stearothermophilus]<br>MRNIRIYSEVKEQGIFFKEVIQSVLEKANVEVVLVNSAMLDYSDVSVISLIRNQKKFDLLVSEVRDKREI<br>PIVMVEFSTAVTTDDHELQRADAMFWAYKYKIPYLKISPMEKKSQTADDKEGGGRLLSVNDQIIHMYRTD<br>GVMYHIEWESMDNSAYVKNAELYPSCPDCAPELASLFRCLLETIEKCENIEDYYRILLDKLGKQKVAVKW<br>GNFREEKTLEQWKHEKFDLLERFSKSSSRMEYDKDKKELKIKVNRYGHAMDPERGILAFWKLVLGDEWKI<br>VAEFQLQRKTLKGRQSYQSLEDEVSQEEKLMNIASEIIKNGNVISPDKAIEIHKLATSSTMISTIDLGTP<br>ERKYITDDSLKGYLQHGLITNIYKNLLYYVDEIRFTDLQRKTIASLTWNKEIVNDYYKSLMDQLLDKNLR<br>VLPLTSIKNISEDLITWSSKEILINLGYKILAASYPEAQGDRCILVGPTGKKTERKFIDLIAISPKSKGV<br>ILLECKDKLSKSKDDCEKMNDLLNHNYDKVIKLINVLNINNYNYNNIIVTGVAGLIGRKNVDNLPVDEVI<br>KFKYDAKNLKLNWEINSDILGKHSGSFSMEDVAVVRKRS |

TABLE 2-continued

<table>
<tr><th colspan="4">List of protein domains for chimeric proteins.</th></tr>
<tr><th>GENBANK/SWISS-PROT ID</th><th>NAME</th><th>SEQ ID NO</th><th>FASTA SEQUENCE</th></tr>
<tr><td>AAL86024.1</td><td>BsmI</td><td>374</td><td>>gi|19347662|gb|AAL86024.1| BsmI [Geobacillus stearothermophilus]<br>MNVFRIHGDNIIECERVIDLILSKINPQKVKRGFISLSCPFIEIIFKEGHDYFHWRFDMFPGFNKNTNDR<br>WNSNILDLLSQKGSFLYETPDVIITSLNNGKEEILMAIEFCSALQAGNQAWQRSGRAYSVGRTGYPYIYI<br>VDFVKYELNNSDRSRKNLRFPNPAIPYSYISHSKNTGNFIVQAYFRGEEYQPKYDKKLKFFDETIFAEDD<br>IADYIIAKLQHRDTSNIEQLLINKNLKMVEFLSKNTKNDNNFTYSEWESIYNGTYRITNLPSLGRFKFRK<br>KIAEKSLSGKVKEENNIVQRYSVGLASSDLPFGVIRKESRNDFINDVCKLYNINDMKIIKELKEDADLIV<br>CMLKGFKPRGDDNRPDRGALPLVAMLAGENAQIFTFIYGPLIKGAINLIDQDINKLAKRNGLWKSFVSLS<br>DFIVLDCPIIGESYNEFRLIINKNNKESILRKTSKQQNILVDPTPNHYQENDVDTVIYSIFKYIVPNCFS<br>GMCNPPGGDWSGLSIIRNGHEFRWLSLPRVSENGKRPDHVIQILDLFEKPLLLSIESKEKPNDLEPKIGV<br>QLIKYIEYLFDFTPSVQRKIAGGNWEFGNKSLVPNDFILLSAGAFIDYDNLTENDYEKIFEVTGCDLLIA<br>IKNQNNPQKWVIKIKPKNTIAEKLVNYIKLNEKSNIFDTGFFHIEG</td></tr>
<tr><td>ADI24225.1</td><td>Nb.BtsCI</td><td>375</td><td>>gi|297185870|gb| ADI24225.1| BtsCI bottom-strand nicking enzyme variant [synthetic construct]<br>MKRILYLLTEERPKINIIHQIINLEYKATLHFGAKIVPVMNEENKFTFIYHVKGIEVEGFDAVLIKIVSG<br>HSSFVDYLVEDSNDLKPEKNTITLFDLDQYELDLSYYFGKGWIVRIPSPSDLPKYVVEETKTDDHESRNT<br>NAYQRSSKFVFCELYYGKEVKKYMLYDISDGRTLSGTDTHNFGMRMLVTNNVNLVGVPNMYLPFTDIKEF<br>INEKNRIADNGPSHNVPIRLKLDKEKNVIYISAKLDKGNGKNKNKISNDPNIGAVAIISATLRNLNWKGD<br>IEIINHNLLPSSISSRSNGNKLLYIMKKLGVRFNNINVNWNNIKNNINYFFYNITSEKIVSIYYHLYVED<br>KLSNARVIEDNHAGCGKSYFRTLNNKIIPVGKEIPLPALVIFDSDQNIVKVIAAAKAENVYNGVEQLSTF<br>DKFIESYINKYYPGAAVECSVITWGKSSNPYVSFYLDKDGSAVFL</td></tr>
<tr><td>ADI24224.1</td><td>Nt.BtsCI</td><td>376</td><td>>gi|297185868|gb|ADI24224.1| BtsCI top-strand nicking enzyme variant [synthetic construct]<br>MKRILYLLTEERPKINIIHQIINLEYKATLHFGAKIVPVMNEENKFTFIYHVKGIEVEGFDAVLIKIVSG<br>HSSFVDYLVFDSNDLKPEKNTITLFDLDQYELDLSYYFGKGWIVRIPSPSDLPKYVVFETKTDDHESRNT<br>NAYQRSSKFVFCELYYGKEVKKYMLYDISDGRTLSGTDTHNFGMRMLVTNNVNLVGVPNMYLPFTDIKEF<br>INEKNRIADNGPSHNVPIRLKLDKEKNVIYISAKLDKGNGKNKNKISNDPNIGAVAIISATLRNLNWKGD<br>IEIINHNLLPSSISSRSNGNKLLYIMKKLGVRFNNINVNWNNIKNNINYFFYNITSEKIVSIYYHLYVED<br>KLSNARVIFDNHAGCGKSYFRTLNNKIIPVGKEIPLPDLVIFDSDQNIVKVIEAEKAENVYNGVEQLSTF<br>DKFIESYINKYYPGAAVECSVITWGKSSNPYVSFYLDKDGSAVFL<br>>gi|85720924|gb|ABC75874.1| R1.BtsI [Geobacillus thermoglucosidasius]<br>MKITEGIVHVAMRHFLKSNGWKLIAGQYPGGSDDELTALNIVDPVVARDNSPDPRRHSLGKIVPDLIAYK<br>NDDLLVIEAKPKYSQDDRDKLLYLLSERKHDFYAALEKFATERNHPELLPVSKLNIIPGLAFSASENKFK<br>KDPGFVYIRVSGIFEAFMEGYDWG</td></tr>
<tr><td>ABC75874.1</td><td>R1.BtsI</td><td>377</td><td>>gi|85720924|gb|ABC75874.1| R1.BtsI [Geobacillus thermoglucosidasius]<br>MKITEGIVHVAMRHFLKSNGWKLIAGQYPGGSDDELTALNIVDPVVARDNSPDPRRHSLGKIVPDLIAYK<br>NDDLLVIEAKPKYSQDDRDKLLYLLSERKHDFYAALEKFATERNHPELLPVSKLNIIPGLAFSASENKFK<br>KDPGFVYIRVSGIFEAFMEGYDWG</td></tr>
<tr><td>ABC75876.1</td><td>R2.BtsI</td><td>378</td><td>>gi|85720926|gb|ABC75876.1| R2.BtsI [Geobacillus thermoglucosidasius]<br>MQIEQLMKSLTIYFDDIQEGLWFKNLHPLLESASLEAITGSLKRNPNLADVLKYDRPDIILTLNQTPILV<br>IERTIEVPSGHNVGQRYGRLAAASEAGVPLVYFGPYAARKHGGATEGPRYMNLRLFYALDVMQKVNGSAI<br>TTINWPVDQNFEILQDPSKDKRMKEYLEMFFDNLLKYGIAGINLAIRNSSFQAEQLAEREKFVETMITNP<br>EQYDVPPDSVQILNAERFFNELGISENKRIICDEVVLYQVGMTYVRSDPYTGMALLYKYLYILGSERNRC<br>LILKFPNITTDMWKKVAFGSRERKDVRIYRSVSDGILFADGYLSKEEL</td></tr>
</table>

TABLE 2-continued

<table>
<tr><th colspan="4">List of protein domains for chimeric proteins.</th></tr>
<tr><th>GENBANK/SWISS-PROT ID</th><th>NAME</th><th>SEQ ID NO</th><th>FASTA SEQUENCE</th></tr>
<tr><td>AAX14652.1</td><td>BbvCI subunit 1</td><td>379</td><td>>gi|60202520|gb|AAX14652.1| BbvCI endonuclease subunit 1 [Brevibacillus brevis]<br>MINEDFFIYEQLSHKKNLEQKGKNAFDEETEELVRQAKSGYHAFIEGINYDEVTKLDLNSSVAALEDYIS<br>IAKEIEKKHKMFNWRSDYAGSIIPEFLYRIVHVATVKAGLKPIFSTRNTIIEISGAAHREGLQIRRKNED<br>FALGFHEVDVKIASESHRVISLAVACEVKTNIDKNKLNGLDFSAERMKRTYPGSAYFLITETLDFSPDEN<br>HSSGLIDEIYVLRKQVRTKNRVQKAPLCPSVFAELLEDILEISYRASNVKGHVYDRLEGGKLIRV</td></tr>
<tr><td>AAX14653.1</td><td>BbvCI subunit 2</td><td>380</td><td>>gi|60202521|gb|AAX14653.1| BbvCI endonuclease subunit 2 [Brevibacillus brevis]<br>MFNQFNPLVYTHGGKLERKSKKDKTASKVFEEFGVMEAYNCWKEASLCIQQRDKDSVIKLVAALNTYKDA<br>VEPIFDSRLNSAQEVLQPSILEEFFEYLFSRIDSIVGVNIPIRHPAKGYLSLSFNPHNIETLIQSPEYTV<br>RAKDHDFIIGGSAKLTIQGHGGEGETTNIVVPAVAIECKRYLERNMLDECAGTAERLKRATPYCLYFVVA<br>EYLKLDDGAPELTEIDEIYILRHQRNSERNKPGFKPNPIDGELIWDLYQEVMNHLGKIWWDPNSALQRGK<br>VFNRP</td></tr>
<tr><td>CAA74998.1</td><td>Bpu10I alpha subunit</td><td>381</td><td>>gi|2894388|emb|CAA74998.1| Bpu10I restriction endonuclease alpha subunit [Bacillus pumilus]<br>MGVEQEWIKNITDMYQSPELIPSHASNLLHQLKREKRNEKLKKALEIITPNYISYISILLNNHNMTRKEI<br>VILVDALNEYMNTLRHPSVKSVFSHQADFYSSVLPEFFNLLFRNLIKGLNEKIKVNSQKDIIIDCIFDPY<br>NEGRVVFKKKRVDVAIILKNKFVFNNVEISDFAIPLVAIEIKTNLDKNMLSGIEQSVDSLKETFPLCLYY<br>CITELADFAIEKQNYASTHIDEVFILRKQKRGPVRRGTPLEVVHADLILEVVEQVGEHLSKFKDPIKTLK<br>ARMTEGYLIKGKGK</td></tr>
<tr><td>CAA74999.1</td><td>Bpu10I beta subunit</td><td>382</td><td>>gi|2894389|emb|CAA74999.1| Bpu10I restriction endonuclease beta subunit [Bacillus pumilus]<br>MTQIDLSNTKHGSILFEKQKNVKEKYLQQAYKHYLYFRRSIDGLEITNDEAIFKLTQAANNYRDNVLYLF<br>ESRPNSGQEAFRYTILEEFFYHLFKDLVKKKFNQEPSSIVMGKANSYVSLSFSPESFLGLYENPIPYIHT<br>KDQDFVLGCAVDLKISPKNELNKENETEIVVPVIAIECKTYIERNMLDSCAATASRLKAAMPYCLYIVAS<br>EYMKMDQAYPELTDIDEVFILCKASVGERTALKKKGLPPHKLDENLMVELFHMVERHLNRVWWSPNEALS<br>RGRVIGRP</td></tr>
<tr><td>ABM69266.1</td><td>BmrI</td><td>383</td><td>>gi|123187377|gb|ABM69266.1| BmrI [Bacillus megaterium]<br>MNYFSLHPNVYATGRPKGLINMLESVWISNQKPGDGTMYLISGFANYNGGIRFYETFTEHINHGGKVIAI<br>LGGSTSQRLSSKQVVAELVSRGVDVYIINRKRLLHAKLYGSSSNSGESLVVSSGNFTGPGMSQNVEASLL<br>LDNNTTSSMGFSWNGMVNSMLDQKWQIHNLSNSNPTSPSWNLLYDERTTNLTLDDTQKVTLILTLGHADT<br>ARIQAAPKSKAGEGSQYFWLSKDSYDFFPPLTIRNKRGTKATYSCLINMNYLDIKYIDSECRVTFEAENN<br>FDFRLGTGKLRYTNVAASDDIAAITRVGDSDYELRIIKKGSSNYDALDSAAVNFIGNRGKRYGYIPNDEF<br>GRIIGAKF</td></tr>
<tr><td>CAC12783.1</td><td>BfiI</td><td>384</td><td>>gi|10798463|emb|CAC12783.1| restriction endonuclease BfiI [Bacillus firmus]<br>MNFFSLHPNVYATGRPKGLIGMLENVWVSNHTPGEGTLYLISGFSNYNGGVRFYETFTEHINQGGRVIAI<br>LGGSTSQRLSSRQVVEELLNRGVEVHIINRKRILHAKLYGTSNNLGESLVVSSGNFTGPGMSQNIEASLL<br>LDNNTTQSMGFSWNDMISEMLNQNWHIHNMTNATDASPGWNLLYDERTTNLTLDETERVTLIVTLGHADT<br>ARIQAAPGTTAGQGTQYFWLSKDSYDFFPPLTIRNRRGTKATYSSLINMNYIDINYTDTQCRVTFEAENN<br>FDFRLGTGKLRYTGVAKSNDIAAITRVGDSDYELRIIKQGTPEHSQLDPYAVSFIGNRGKRFGYISNEEF<br>GRIIGVTF</td></tr>
<tr><td>P05725.1</td><td>I-CreI</td><td>385</td><td>>gi|140470|Sp|P05725.1| DNE1_CHLRE RecName: Full = DNA endonuclease I-CreI; AltName:<br>Full = 23S rRNA intron protein<br>MNTKYNKEFLLYLAGFVDGDGSIIAQIKPNQSYKFKHQLSLAFQVTQKTQRRWFLDKLVDEIGVGYVRDR</td></tr>
</table>

TABLE 2-continued

<table>
<tr><td colspan="4">List of protein domains for chimeric proteins.</td></tr>
<tr><th>GENBANK/SWISS-PROT ID</th><th>NAME</th><th>SEQ ID NO</th><th>FASTA SEQUENCE</th></tr>
<tr><td></td><td></td><td></td><td>GSVSDYILSEIKPLHNFLTQLQPFLKLKQKQANLVLKIIWRLPSAKESPDKFLEVCTWVDQIAALNDSKT<br>RKITSETVRAVLDSLSEKKKSSP</td></tr>
<tr><td>Q9UQ84.2</td><td>hExoI<br>(EXO1_HUMAN)</td><td>386</td><td>>gi|85700954|sp|Q9UQ84.2| EXO1_HUMAN RecName: Full = Exonuclease 1; Short = hExoI; AltName:<br>Full = Exonuclease I; Short = hExoI<br>MGIQGLLQFIKEASEPIHVRKYKGQVVAVDTYCWLHKGAIACAEKLAKGEPTDRYVGFCMKFVNMLLSHG<br>IKPILVFDGCTLPSKKEVERSRRERRQANLLKGKQLLREGKVSEARECFTRSINITHAMAHKVIKAARSQ<br>GVDCLVAPYEADAQLAYLNKAGIVQAIITEDSDLLAFGCKKVILKMDQFGNGLEIDQARLGMCRQLGDVF<br>TEEKFRYMCILSGCDYLSSLRGIGLAKACKVLRLANNPDIVKVIKKIGHYLKMNITVPEDYINGFIRANN<br>TFLYQLVFDPIKRKLIPLNAYEDDVDPETLSYAGQYVDDSIALQIALGNKDINTFEQIDDYNPDTAMPAH<br>SRSHSWDDKTCQKSANVSSIWHRNYSPRPESGTVSDAPQLKENPSTVGVERVISTKGLNLPRKSSIVKRP<br>RSAELSEDDLLSQYSLSFTKKTKKNSSEGNKSLSFSEVEVPDLVNGPTNKKSVSTPPRTRNKFATFLQRK<br>NEESGAVVVPGTRSRFFCSSDSTDCVSNKVSIQPLDETAVTDKENNLHESEYGDQEGKRLVDTDVARNSS<br>DDIPNNHIPGDHIPDKATVFTDEESYSFESSKFTRTISPPTLGTLRSCFSWSGGLGDFSRTPSPSPSTAL<br>QQFRRKSDSPTSLPENNMSDVSQLKSEESSDDESHPLREEACSSQSQESGEFSLQSSNASKLSQCSSKDS<br>DSEESDCNIKLLDSQSDQTSKLRLSHFSKKDTPLRNKVPGLYKSSSADSLSTTKIKPLGPARASGLSKKP<br>ASIQKRKHHNAENKPGLQIKLNELWKNFGFKKDSEKLPPCKKPLSPVRDNIQLTPEAEEDIFNKPECGRV<br>QRAIFQ</td></tr>
<tr><td>P39875.2</td><td>Yeast ExoI<br>(EXO1_YEAST)</td><td>387</td><td>>gi|1706421|sp|P39875.2| EXO1_YEAST RecName: Full = Exodeoxyribonuclease 1; AltName: Full =<br>Exodeoxyribonuclease I; Short = EXO I; Short = Exonuclease I; AltName: Full = Protein DHS1<br>MGIQGLLPQLKPIQNPVSLRRYEGEVLAIDGYAWLHRAACSCAYELAMGKPTDKYLQFFIKRFSLLKTFK<br>VEPYLVFDGDAIPVKKSTESKRRDKRKENKAIAERLWACGEKKNAMDYFQKCVDITPEMAKCIICYCKLN<br>GIRYIVAPFEADSQMVYLEQKNIVQGIISEDSDLLVEGCRRLITKLNDYGECLEICRDNFIKLPKKFPLG<br>SLTNEEIITMVCLSGCDYINGIPKVGLITAMKLVRRFNTIERIILSIQREGKLMIPDTYINEYEAAVLAF<br>QFQRVFCPIRKKIVSLNEIPLYLKDTESKRKRLYACIGFVIHRETQKKQIVHFDDDIDHHLHLKIAQGDL<br>NPYDFHQPLANREHKLQLASKSNIEFGKTNTTNSEAKVKPIESFFQKMTKLDHNPKVANNIHSLRQAEDK<br>LTMAIKRRKLSNANVVQETLKDTRSKFFNKPSMTVVENFKEKGDSIQDFKEDTNSQSLEEPVSESQLSTQ<br>IPSSFITTNLEDDDNISEEVSEVVSDIEEDRKNSEGKTIGNEIYNTDDDGDGDTSEDYSETAESRVPTSS<br>TTSFPGSSQRSISGCTKVLQKFRYSSSFSGVNANRQPLFPRHVNQKSRGMVYVNQNRDDDCDDNDGKNQI<br>TQRPSLRKSLIGARSQRIVIDMKSVDERKSFNSSPILHEESKKRDIETTKSSQARPAVRSISLLSQFVYK<br>GK</td></tr>
<tr><td>BAJ43803.1</td><td>E.coli ExoI</td><td>388</td><td>>gi|315136644|dbj|BAJ43803.1| exonuclease I [Escherichia coli DH1]<br>MMNDGKQQSTFLFHDYETFGTHPALDRPAQFAAIRTDSEFNVIGEPEVFYCKPADDYLPQPGAVLITGIT<br>PQEARAKGENEAAFAARIHSLFTVPKTCILGYNNVRFDDEVIRNIFYRNFYDPYAWSWQHDNSRWDLLDV<br>MRACYALRPEGINWPENDDGLPSFRLEHLTKANGIEHSNAHDAMADVYATIAMAKLVKTRQPRLFDYLFT<br>HRNKHKLMALIDVPQMKPLVHVSGMFGAWRGNTSWVAPLAWHPENRNAVIMVDLAGDISPLLELDSDTLR<br>ERLYTAKTDLGDNAAVPVKLVHINKCPVLAQANTLRPEDADRLGINRQHCLDNLKILRENPQVREKVVAI<br>FAEAEPFTPSDNVDAQLYNGFFSDADRAAMKIVLETEPRNLPALDITFVDKRIEKLLFNYRARNFPGILD<br>YAEQQRWLEHRRQVFTPEFLQGYADELQMLVQQYADDKEKVALLICALWQYAEEIV</td></tr>
</table>

TABLE 2-continued

List of protein domains for chimeric proteins.

| GENBANK/SWISS-PROT ID | NAME | SEQ ID NO | FASTA SEQUENCE |
|---|---|---|---|
| Q9BQ50.1 | Human TREX2 | 389 | >gi\|47606206\|sp\|Q98Q50.1\| TREX2_HUMAN RecName: Full = Three prime repair exonuclease 2; AltName: Full = 3'-5' exonuclease TREX2 MGRAGSPLPRSSWPRMDDCGSRSRCSPTLCSSLRTCYPRGNITMSEAPRAETFVFLDLEATGLPSVEPEI AELSLFAVHRSSLENPEHDESGALVLPRVLDKLTLCMCPERPFTAKASEITGLSSEGLARCRKAGFDGAV VRTLQAFLSRQAGPICLVAHNGFDYDFPLLCAELRRLGARLPRDTVCLDTLPALRGLDRAHSHGTRARGR QGYSLGSLFHRYFRAEPSAAHSAEGDVHTLLLIFLHFLAAELLAWADEQARGWAHIEPMYLPPDDPSLEA |
| Q91XB0.2 | Mouse TREX1 | 390 | >gi\|47606196\|sp\|Q91XB0.2\| TREX1_MOUSE RecName: Full = Three prime repair exonuclease 1; AltName: Full = 3'-5' exonuclease TREX1 MGSQTLPHGHMQTLIFLDLEATGLPSSRPEVTELCLLAVHRRALENTSISQGHPPPVPRPPRVVDKLSLC IAPGKACSPGASEITGLSKAELEVQGRQRFDDNLAILLRAFLQRQPQPCCLVAHNGDRYDFPLLQTELAR LSTPSPLDGTFCVDSIAALKALEQASSPSGNGSRKSYSLGSIYTRLYWQAPTDSHTAEGDVLTLLSICQW KPQALLQWVDEHARPFSTVKPMYGTPATTGTTNLRPHAATATTPLATANGSPSNGRSRRPKSPPPEKVPE APSOEGLLAPLSLLTLLTLAIATLYGLFLASPGQ |
| Q9N5U2.1 | Human TREX1 | 391 | >gi\|47606216\|sp\|Q9NSU2.1\| TREX1_HUMAN RecName: Full = Three prime repair exonuclease 1; AltName: Full = 3'-5' exonuclease TREX1; AltName: Full = DNase III MGPGARRQGRIVQGRPEMCFCPPPTPLPPLRILTLGTHIPTPCSSPGSAAGTYPTMGSQALPPGPMQTLI FFDMEATGLPFSCIPKVTELCUAVHRCALESPPTSQGPPPTVPPPPRVVDKLSLCVAPGKACSPAASEIT GLSTAVLAAHGRQCFDDNIANLLLAFLRRQPQPWCLVAHNGDRYDFPLLQAELAMLGLTSALDGAFCVDS ITALKALERASSPSEHGPRKSYSLGSIYTRLYGQSPPDSHTAEGDVIALLSICQWRPQALLRWVDAHARP FGTIRPMYGVTASARTKPRPSAVTTTAHLATTRNTSPSLGESRGTKDLPPVXDPGALSREGLLAPLGLLA ILTLAVATLYGLSLATPGE |
| Q9BG99.1 | Bovine TREX1 | 392 | >gi\|47606205\|sp\|Q98G99.1\| TREX1_BOVIN RecName: Full = Three prime repair exonuclease 1; AltName: Full = 3'-5' exonuclease TREX1 MGSRALPPGPVQTLIFLDLEATGLPFSQPKITELCLLAVHRYALEGLSAPQGPSPTAPVPPRVLDKLSLC VAPGKVCSPAASEITGLSTAVLAAHGRRAFDADLVNLIRTFLQRQPQPWCLVAHNGDRYDFPLLRAELAL LGLASALDDAFCVDSIAALKALEPTGSSSEHGPRKSYSLGSVYTRLYGQAPPDSHTAEGDVLALLSVCQW RPRALLRWVDAHAKPFSTVKPMYVITTSTGTNPRPSAVTATVPLARASDTGPNLRGDRSPKPAPSPKMCP GAPPGEGLLAPLGLLAFLTLAVAMLYGLSLAMPGQ |
| AAH91242.1 | Rat TREX1 | 393 | >gi\|60688197\|gb\|AAH91242.1\| Trex1 protein [*Rattus norvegicus*] MGSQALPHGHMQTLIFLDLEATGLPYSQPKITELCLIAVHRHALENSSMSEGQPPPVPKPPRVVDKLSLC IAPGKPCSSGASEITGLTTAGLEAHGRQRFNDNLATLLQVFLQRQPQPCCLVAHNGDRYDFPLLQAELAS LSVISPLDGTFCVDSIAALKTLEQASSPSEHGPRKSYSLGSIYTRLYGQAPTDSHTAEGDVLALLSICQW KPQALLQWVDKHARPFSTIKPMYGMAATTGTASPRLCAATTSSPLATANLSPSNGRSRGKRPTSPPPENV PEAPSREGLLAPLGLLTFLTLAIAVLYGIFLASPGQ |
| AAH63664.1 | Human DNA2 | 394 | >gi\|39793966\|gb\|AAH63664.1\| DNA2 protein [*Homo sapiens*] FAIPASRMEQLNELELLMEKSFWEEAELPAELFQKKVVASFPRTVLSTGMDNRYLVLAVNTVQNKEGNCE KRLVITASQSLENKELCILRNDWCSVPVEPGDIIHLEGDCTSDTWIIDKDFGYLILYPDMLISGTSIASS IRCMRRAVLSETFRSSDPATRQMLIGTVLHEVFQKAINNSFAPEKLQELAFQTIQEIRHLKEMYRLNLSQ DEIKQEVEDYLPSFCKWAGDFMHKNTSTDFPQMQLSLPSDNSKDNSTCNIEVVKPMDIEESIWSPRFGLK GKIDVTVGVKIHRGYKTKYKIMPLELKTGKESNSIEHRSQVVLYTLLSQERRADPEAGLLLYLKTGQMYP VPANHLDKRELLKLRNQMAFSLFHRISKSATRQKTQLASLPQIIEEEKTCKYCSQIGNCALYSRAVEQQM |

TABLE 2-continued

<table>
<tr><th colspan="4">List of protein domains for chimeric proteins.</th></tr>
<tr><th>GENBANK/SWISS-PROT ID</th><th>NAME</th><th>SEQ ID NO</th><th>FASTA SEQUENCE</th></tr>
<tr><td></td><td></td><td></td><td>DCSSVPIVMLPKIEEETQHLKQTHLEYFSLWCLMLTLESQSKDNKKNHQNIWLMPASEMEKSGSCIGNLI<br>RMEHVKIVCDGQYLHNFQCKHGAIPVTNLMAGDRVIVSGEERSLFALSRGYVKEINMTTVTCLLDRNLSV<br>LPESTLFRLDQEEKNCDIDTPLGNLSKLMENTFVSKKLRDLIIDFREPQFISYLSSVLPHDAKDTVACIL<br>KGLNKPQRQAMKKVLLSKDYTLIVGMPGTGKTTTICTLVPAPEQVEKGGVSNVTEAKLIVFLTSIFVKAG<br>CSPSDIGIIAPYRQQLKIINDLLARSIGMVEVNTVDKYQGRDKSIVLVSFVRSNKDGTVGELLKDWRRLN<br>VAITRAKHKLILLGCVPSLNCYPPLEKLLNHLNSEKLIIDLPSREHESLCHILGDFQRE</td></tr>
<tr><td>P38859.1</td><td>Yeast DNA2 (DNA2_YEAST)</td><td>395</td><td>>gi|731738|sp|P38859.1| DNA2_YEAST RecName: Full = DNA replication ATP-dependent helicase DNA2<br>MPGTPQKNKRSASISVSPAKKTEEKEIIQNDSKAILSKQTKRKKKYAFAPINNLNGKNTKVSNASVLKSI<br>AVSQVRNTSRTKDINKAVSKSVKQLPNSQVKPKREMSNLSRHHDFTQDEDGPMEEVIWKYSPLQRDMSDK<br>TTSAAEYSDDYEDVQNPSSTPIVPNRLKTVLSFTNIQVPNADVNQLIQENGNEQVRPKPAEISTRESLRN<br>IDDILDDIEGDLTIKPTITKFSDLPSSPIKAPNVEKKAEVNAEEVDKMDSTGDSNDGDDSLIDILTQKYV<br>EKRKSESQITIQGNTNQKSGAQESCGKNDNTKSRGEIEDHENVDNQAKTGNAFTENEEDSNCQRIKKNEK<br>IEYNSSDEFSDDSLIELLNETQTQVEPNTIEQDLDKVEKMVSDDLRIATDSTLSAYALRAKSGAPRDGVV<br>RLVIVSLRSVELPKIGTQKILECIDGKGEQSSVVVRHPWVYLEFEVGDVIHIIEGKNIENKRLLSDDKNP<br>KTQLANDNLLVLNPDVLFSATSVGSSVGCLRRSILQMQFQDPRGEPSLVMTLGNIVHELLQDSIKYKLSH<br>NKISMEIIIQKLDSLLETYSFSIIICNEEIQYVKELVMKEHAENILYFVNKFVSKSNYGCYTSISGTRRT<br>QPISISNVIDIEENIWSPITGLKGFLDATVEANVENNKKHIVPLEVKTGKSRSVSTEVQGLITTLLLNDR<br>YEIPIEFFLLYFTRDKNMTKFPSVLHSIKHILMSRNRMSMNFKHQLQEVFGQAQSRFELPPLLRDSSCDS<br>CFIKESCMVLNKLLEDGTPEESGLVEGEFEILTNHLSQNLANYKEFFTKYNDLITKEESSITCVNKELFL<br>LDGSTRESRSGRCLSGLVVSEVVEHEKTEGATITCFSRRRNDNNSQSMLSSQIAANDFVIISDEEGHFCL<br>CQGRVQFINPAKIGISVKRKLLNNRLLDKEKGVTTIQSVVESELEQSSLIATQNLVTYRIDKNDIQQSLS<br>LARFNLLSLFLPAVSPGVDIVDERSKLCRKTKRSDGGNEILRSLLVDNRAPKFRDANDDPVIPYKLSKDT<br>TLNLNQKEAIDKVMRAEDYALILGMPGTGKTIVIAEIIKILVSEGKRVLLTSYTHSAVDNILIKLRNTNI<br>SIMRLGMKHKVHPDTQKYVPNYASVKSYNDYLSKINSTSVVATTCLGINDILFTLNEKDFDYVILDEASQ<br>ISMPVALGPLRYGNRFIMVGDHYQLPPLVKNDAARLGGLEESLFKTFCEKHPESVAELTLQTRMCGDIVT<br>LSNFLIYDNKLKCGNNEVFAQSLELPMPEALSRYRNESANSKQWLEDILEPTRKVVFLNYDNCPDIIEQS<br>EKDNITNHGEAELTLQCVEGMLLSGVPCEDIGVMTLYRAQLRLLKKIFNKNVYDGLEILTADQFQGRDKK<br>CIIISMVRRNSQLNGGALLKELRRVNVAMTRAKSKLIIIGSKSTIGSVPEIKSFVNLLEERNWVYTMCKD<br>ALYKYKFPDRSNAIDEARKGCGKRTGAKPITSKSICNSDKPIIKEILQEYES</td></tr>
<tr><td>AAA45863.1</td><td>VP16</td><td>396</td><td>>gi|330318|gb|AAA45863.1| VP16 herpesvirus 21<br>MDLLVDDLFADRDGVSPPPPRPAGGPKNIPAAPPLYATGRLSQAQLMPSPPMPVPPAALFNRLLDDLGFS<br>AGPALCTMLDTWNEDLFSGFPTNADMYRECKFLSTLPSDVIDWGDAHVPERSPIDIRAHGDVAFPTLPAT<br>RDELPSYYEAMAQFFRGELRAREESYRTVLANFCSALYRYLRASVRQLHRQAHMRGRNRDLREMLRTTIA<br>DRYYRETARLARVLFLHLYLFLSREILWAAYAEQMMRPDLFDGLCCDLESWRQLACLFQPLMFINGSLTV<br>RGVPVEARRLRELNHIREHLNLPLVRSAAAEEPGAPITTPPVLQGNQARSSGYFMLLIRAKLDSYSSVAT<br>SEGESVMREHAYSRGRTRNNYGSTIEGLLDLPDDDDAPAEAGLVAPRMSFLSAGQRPRRLSTTAPITDVS<br>LGDELRLDGEEVDMTPADALDDFDLEMLGDVESPSPGMTHDPVSYGALDVDDIEFEQMFTDAMGIDDFGG</td></tr>
<tr><td>GeneID:5932<br>UniProtKB/Swiss-Prot:<br>Q99708</td><td>RBBP8<br>retinoblastoma<br>binding<br>protein 8</td><td>397</td><td>MNISGSSCGSPNSADTSSDFKDLWTKLKECHDREVQGLQVKVTKLKQERILDAQRLEEFF<br>TKNQQLREQQKVLHETIKVLEDRLRAGLCDRCAVTEEHMRKKQQEFENIRQQNLKLITEL<br>MNERNTLQEENKKLSEQLQQKIENDQQHQAAELECEEDVIPDSPITAFSFSGVNRLRRKE<br>NPHVRYIEQTHTKLEHSVCANEMRKVSKSSTHPQHNPNENEILVADTYDQSQSPMAKAHG<br>TSSYTPDKSSFNLATVVAETLGLGVQEESETQGPMSPLGDELYHCLEGNHKKQPFEESTR<br>NTEDSLRFSDSTSKTPPQEELPTRVSSPVFGATSSIKSGLDLNTSLSPSLLQPGKKKHLK</td></tr>
</table>

TABLE 2-continued

List of protein domains for chimeric proteins.

| GENBANK/SWISS-PROT ID | NAME | SEQ ID NO | FASTA SEQUENCE |
|---|---|---|---|
| | | | TLPFSNTCISRLEKTRSKSEDSALFTHHSLGSEVNKIIIQSSNKQILINKNISESLGEQN<br>RTEYGKDSNTDKHLEPLKSLGGRTSKRKKTEEESEHEVSCPQASFDKENAFPFPMDNQFS<br>MNGDCVMDKPLDLSDRFSAIQRQEKSQGSETSKNKFRQVTLYEALKTIPKGFSSSRKASD<br>GNCTLPKDSPGEPCSQECIILQPLNKCSPDNKPSLQIKEENAVFKIPLRPRESLETENVL<br>DDIKSAGSHEPIKIQTRSDHGGCELASVLQLNPCRTGKIKSLQNNQDVSFENIQWSIDPG<br>ADLSQYKMDVTVIDTKDGSQSKLGGETVDMDCTLVSETVLLKMKKQEQKGEKSSNEERKM<br>NDSLEDMFDRTTHEEYESCLADSFSQAADEEEELSTATKKLHTHGDKQDKVKQKAFVEPY<br>FKGDERETSLQNFPHIEVVRKKEERRKLLGHTCKECEIYYADMPAEEREKKLASCSRHRF<br>RYIPPNTPENFWEVGFPSTQTCMERGYIKEDLDPCPRPKRRQPYNAIFSPKGKEQKT |
| ACM07430.1 | Colicin E9 | 598 | >gi\|221185856\|gb\|ACM07430.1\| colicin E9 [Escherichia *coli*]<br>MSGGDGRGHNTGAHSTSGNINGGPTGIGVSGGASDGSGWSSENNPWGGGSGSGIHWGGGSGRGNGGG<br>NGN<br>SGGGSGTGGNLSAVAAPVAFGFPALSTPGAGGLAVSISASELSAAIAGIIAKLKKVNLKFTPFGVVL<br>SSL<br>IPSEIAKDDPNMMSKIVTSLPADDITESPVSSLPLDKATVNVNVRVVDDVKDERQNISVVSGVPMSV<br>PVV<br>DAKPTERPGVFTASIPGAPVLNISVNDSTPAVQTLSPGVTNNTDKDVRPAGFTQGGNTRDAVIRFPK<br>DSG<br>HNAVYVSVSDVLSPDQVKQRQDEENRRQQEWDATHPVEAAERNYERARAELNQANEDVARNQERQAK<br>AVQ<br>VYNSRKSELDAANKTLADAIAEIKQFNRFAHDPMAGGHRMWQMAGLKAQRAQTDVNNKQAAFDAAAK<br>EKS<br>DADAALSAAQERRKQKENKEKDAKDKLDKESKRNKPGKATGKGKPVGDKWLDDAGKDSGAPIPDRIA<br>DKL<br>RDKEFKSFDDFRKAVWEEVSKDPELSKNLNPSNKSSVSKGYSPFTPKNQQVGGRKVYELHHDKPISQ<br>GGE<br>VYDMDNIRVTTPKRHIDIHRGK |
| NP_775816.1 | APFL | 599 | >gi\|135233\|sp\|P14870.1\| T2F1_PLAOK RecName: Full = Type-2 restriction enzyme FokI; Short = R.FokI; AltName: Full = Endonuclease FokI; AltName: Full = Type II restriction enzyme FokI; AltName: Full = Type IIS restriction enzyme FokI<br>MFLSMVSKIRTFGWVQNPGKFENLKRVVQVFDRNSKVHNEVKNIKIPTLVKESKIQKELVAIMNQHD<br>LIY<br>TYKELVGTGTSIRSEAPCDAIIQATIADQGNKKGYIDNWSSDGFLRWAHALGFIEYINKSDSFVITD<br>VGL<br>AYSKSADGSAIEKEILIEAISSYPPAIRILTLLEDGQHLTKFDLGKNLGFSGESGFTSLPEGILLDT<br>LAN<br>AMPKDKGEIRNNWEGSSDKYARMIGGWLDKLGLVKQGKKEFIIPTLGKPDNKEFISHAFKITGEGLK<br>VLR<br>RAKGSTKFTRVPKRVYWEMLATNLTDKEYVRTRRALILEILIKAGSLKIEQIQDNLKKLGFDEVIET<br>IEN<br>DIKGLINTGIFIEIKGRFYQLKDHILQFVIPNRGVTKQLVKSELEEKKSELRHKLKYVPHEYIELIE<br>IAR<br>NSTQDRILEMKVMEFFMKVYGYRGKHLGGSRKPDGAIYTVGSPIDYGVIVDTKAYSGGYNLPIGQAD<br>EMQ |

TABLE 2-continued

<table>
<tr><th colspan="4">List of protein domains for chimeric proteins.</th></tr>
<tr><th>GENBANK/SWISS-PROT ID</th><th>NAME</th><th>SEQ ID NO</th><th>FASTA SEQUENCE</th></tr>
<tr><td></td><td></td><td></td><td>RYVEENQTRNKHINPNEWWKVYPSSVTEFKFLFVSGHFKGNYKAQLTRLNHITNCNGAVLSVEELLI<br>GGE<br>MIKAGTLTLEEVRRKFNNGEINF</td></tr>
<tr><td>P14870.1</td><td>FokI</td><td>600</td><td>>gi|221185857|gb|ACM07431.1| colicin E9 immunity protein<br>[Escherichia coli]<br>MELKHSISDYTEAEFLQLVTTICNADTSSEEELVKLVTHFEEMTEHPSGSDLIYYPKEGDDDSPSGI<br>VNT<br>VKQWRAANGKSGFKQG</td></tr>
</table>

In this last case, the chimeric protein according to the invention can comprise from its N-terminus toward its C-terminus: A first set of RVDs, a first linker, a protein domain, a second linker, a second set of RVDs. In another example for this case, the chimeric protein according to the invention can comprise a N-terminus domain as previously mentioned, a first set of RVDs, a first linker, a protein domain, a second linker, a second set of RVDs and a C-terminus domain as previously mentioned (as illustrated on FIG. 9B). As exemplified above, linkers used in this case of chimeric protein according to the present invention can be active linkers comprising active domains which allow a change of their structure under appropriate stimulation.

In the scope of the present invention, the chimeric protein comprises a core scaffold with any combination between an additional C-terminus domain according to the invention and an additional N-terminus domain according to the invention.

In another embodiment, said protein domain within the chimeric protein according to the present invention is a first protein subdomain interacting with a second protein subdomain to form said catalytic entity able to process said nucleic acid target sequence. In a preferred embodiment, said first protein subdomain is selected from some of the group listed in Table 2 (SEQ ID NO: 339 to 397), such as MmeI (SEQ ID NO: 339), R.PleI (SEQ ID NO: 369), MlyI (SEQ ID NO: 370) as non-limiting examples, a functional mutant, a variant or derivatives of these protein subdomains thereof. In another preferred embodiment, said second protein subdomain is selected from some of the group listed in Table 2 (SEQ ID NO: 339 to 397 and SEQ ID NO: 598-599), such as MmeI (SEQ ID NO: 339), R.PleI (SEQ ID NO: 369), Mlyl (SEQ ID NO: 370) as non-limiting examples, a functional mutant, a variant or derivatives of these protein subdomains thereof.

In another embodiment, said protein domain within the chimeric protein according to the present invention is a first protein subdomain interacting with a second protein subdomain to form a protein entity catalytically active. Said first protein subdomain can be used to measure, quantify or provoke protein-protein interactions at said nucleic target sequence according to the present invention. Said first protein subdomain can be a protein module or protein subdomain known to mediate protein-protein interaction in cell signaling. Said first protein subdomain can be used for diagnosis, analytical or therapeutic applications. Said protein entity can be a reporter protein such as a fluorescent protein, luciferase, β-galactosidase as non-limiting examples. In this case, a first part of the reporter protein can be fused to said first protein subdomain according to the present invention and a second part of the reporter protein can be fused to said second protein subdomain, wherein said reporter protein is only active when said first and second protein subdomains according to the present invention interact. In another embodiment, said first protein subdomain or the protein entity resulting from the interaction between first and second subdomains can be used as intracellular sensor for calcium level, pH, redox environment as non-limiting examples. In another embodiment, said protein domain or subdomains are usable for applications such as Fluorescence Resonance Energy Transfer (FRET) as a non-limiting example. In another embodiment, said protein domain or subdomains are coupled to a dye.

In another embodiment, said protein domain within the chimeric protein according to the present invention can be an inactive subdomain and can react with more than one protein domain or subdomain to form an active protein entity, i.e. said active entity can be comprising two, three, four or several subdomains and being an enzyme or a fluorescent protein as non-limiting example. In another embodiment, said active entity formed with the chimeric protein according to the present invention can interact or react with another protein or protein domain having a different activity. In another embodiment, said active entity formed with the chimeric protein according to the present invention can be associated within, or located 5' or located 3' regarding the nucleic acid target sequence location with another protein or protein domain having a different activity in order to process said nucleic acid target sequence; as a non-limiting example, said chimeric protein according to the present invention can comprise a protein domain with a cleavase activity for its nucleic acid target sequence and can be associated with an exonuclease activity to increase the mutagenesis rate at its nucleic acid target sequence location.

In another embodiment, said second protein subdomain interacting with said first protein subdomain to form said catalytic entity able to process said nucleic acid target sequence according to the present invention is fused to a core scaffold comprising a set of Repeat Variable Dipeptide regions (RVDs) able to bind a second unique nucleic sequence adjacent to said nucleic acid target sequence wherein each RVD comprises a pair of amino acids responsible for recognizing one nucleotide selected from the group consisting of HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A. More preferably, RVDs associated with recognition of the nucleotides C, T, A, G/A and G respectively are selected from the group consisting of NN or NK for recognizing G, HD for recognizing C, NG for recognizing T and NI for recognizing A, TL for recognizing A, VT for recognizing A or G and SW for recognizing A. In another embodiment, RVDS associated with recognition of the nucleotide C are selected from the group consisting of N* and RVDS associated with recognition of the nucleotide T are selected from the group consisting of N* and H*, where * denotes a gap in the repeat sequence that corresponds to a lack of amino acid residue at the second position of the RVD. In another embodiment, critical amino acids 12 and 13 can be mutated towards other amino acid residues in order to modulate their specificity towards nucleotides A, T, C and G and in particular to enhance this specificity. By other amino acid residues is intended any of the twenty natural amino acid residues or unnatural amino acids derivatives.

In another embodiment, said core scaffold fused to said second protein subdomain can have the same scope of characteristics that those previously listed to describe the chimeric protein according to the present invention, regarding the origin of said core scaffold, the number of RVDs comprised in said core scaffold, the nature of those RVDs (natural, artificial or RVDs-like domains), the existence of additional N-terminus or C-terminus or both domains on this core scaffold, the existence of one or several localization signals on this core scaffold, the existence of one or several peptidic linkers on this core scaffold to fuse one or several protein domains on this core scaffold.

In another aspect of the invention, said chimeric protein according to the present invention can function as a dimer wherein a first and a second monomer are derived from a Transcription Activator-Like Effector (TALE). In another embodiment, said chimeric protein according to the present invention can function as a dimer wherein said first monomer comprises:

(i) A core scaffold comprising a set of Repeat Variable Dipeptide regions (RVDs) able to bind a first nucleic acid sequence adjacent to a nucleic acid target sequence to process wherein each RVD comprises a pair of amino acids responsible for recognizing one nucleotide selected from the group consisting of HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A.

(ii) A protein domain part of a catalytic entity able to process said nucleic acid target sequence;

and wherein said second monomer comprises:

(i) A core scaffold comprising a set of Repeat Variable Dipeptide regions (RVDs) able to bind a second nucleic acid sequence adjacent to a nucleic acid target sequence to process wherein each RVD comprises a pair of amino acids responsible for recognizing one nucleotide selected from the group consisting of HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A.

(ii) A protein domain part of a catalytic entity able to process said nucleic acid target sequence;

thereby obtaining a chimeric protein or a chimeric dimer protein that is a comprising a catalytic entity able to process said nucleic acid target sequence.

More preferably, in said first and second monomers RVDs associated with recognition of the nucleotides C, T, A, G/A and G respectively are selected from the group consisting of NN or NK for recognizing G, HD for recognizing C, NG for recognizing T and NI for recognizing A, TL for recognizing A, VT for recognizing A or G and SW for recognizing A. In another embodiment, in said first and second monomers RVDS associated with recognition of the nucleotide C are selected from the group consisting of N* and RVDS associated with recognition of the nucleotide T are selected from the group consisting of N* and H*, where * denotes a gap in the repeat sequence that corresponds to a lack of amino acid residue at the second position of the RVD. In another embodiment, critical amino acids 12 and 13 in said first and second monomers can be mutated towards other amino acid residues in order to modulate their specificity towards nucleotides A, T, C and G and in particular to enhance this specificity. By other amino acid residues is intended any of the twenty natural amino acid residues or unnatural amino acids derivatives.

In another embodiment, said core scaffolds of the first and second monomers can have the same scope of characteristics that those previously listed to describe the chimeric protein according to the present invention, regarding the origin of said core scaffolds, the number of RVDs comprised in said core scaffolds, the nature of those RVDs (natural, artificial or RVDs-like domains), the existence of additional N-terminus or C-terminus or both domains on these core scaffolds, the existence of one or several localization signals on these core scaffolds, the existence of one or several peptidic linkers on these core scaffolds to fuse one or several protein domains on these core scaffolds.

In a preferred embodiment, at least one monomer is selected from the group consisting of SEQ ID NO: 19 to 133, SEQ ID NO: 180-182, and SEQ ID NO: 186-188, a functional mutant, a variant or a derivative thereof. In a preferred embodiment, said first and second monomers are selected from the group consisting of SEQ ID NO: 19 to 133, SEQ ID NO: 180-182, and SEQ ID NO: 186-188, functional mutants, variants or derivatives thereof.

In another embodiment, said first and second monomers are fused by a peptidic linker forming a single polypeptide chain for simple and efficient vectorization. In another embodiment, said peptidic linker contains one or several active domains which allow its deployment under stimulation, as previously mentionned.

In another embodiment, said first and second monomers have the same amino acid sequences and recognize the same nucleic acid sequence adjacent to said nucleic target sequence. In another embodiment, said first and second monomers have different amino acid sequences and recognize the same nucleic acid sequence adjacent to said nucleic target sequence, i.e first and second monomers are isoschizomers. In another embodiment, said first and second monomers have the same amino acid sequences and recognize different nucleic acid sequences adjacent to said nucleic target sequence because of TAL code degeneracy. In another embodiment, said first and second monomers have different amino acid sequences and recognize different nucleic acid sequences adjacent to said nucleic target sequence.

In another embodiment, said chimeric protein according to the present invention binds a first and a second nucleic acid sequences which are on the same nucleic acid strand adjacent of said nucleic acid target sequence. In another embodiment, said chimeric protein according to the present invention binds a first and a second nucleic acid sequences which are adjacent to said nucleic acid target sequence but not on the same nucleic acid strand. In another embodiment, said chimeric protein according to the present invention binds a first and a second nucleic acid sequences which are located 5' of said nucleic acid target sequence. In another embodiment, said chimeric protein according to the present invention binds a first and a second nucleic acid sequences which are located 3' of said nucleic acid target sequence. In another embodiment, said chimeric protein according to the present invention binds a first nucleic sequence which is 5' located of said nucleic acid sequence target and a second nucleic acid sequence which is 3' located of said nucleic acid sequence target.

In another embodiment, said chimeric protein according to the present invention binds a first and a second nucleic acid sequences which are adjacent to said nucleic acid target sequence and separated by a nucleic acid sequence (i.e. the spacer) of 5-40 base pairs (bp), i.e. the spacer length. In another embodiment, said chimeric protein according to the present invention binds a first and a second nucleic acid sequences which are adjacent to said nucleic acid target sequence and separated by a spacer of 8 bp length.

Some structures of chimeric dimer proteins according to the invention are given on FIG. 9.

In another embodiment, said chimeric dimer protein according to the present invention can be associated with a third chimeric protein comprising:

(i) A core scaffold comprising a set of Repeat Variable Dipeptide regions (RVDs) able to bind a nucleic acid sequence adjacent to a nucleic acid target sequence to process wherein each RVD comprises a pair of amino acids responsible for recognizing one nucleotide selected from the group consisting of HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A.

(ii) protein catalytic domain.

Said third chimeric protein can have the same scope of characteristics that those previously listed regarding the origin of said core scaffold, the number of RVDs comprised in said core scaffold, the nature of those RVDs (natural, artificial or RVDs-like domains), the existence of additional N-terminus or C-terminus or both domains on this core scaffold, the existence of one or several localization signals on this core scaffold, the existence of one or several peptidic linkers on this core scaffold to fuse one or several protein domains on this core scaffold and the nature and characteristics of its protein(s) domain(s) or subdomain(s).

In another embodiment, said third chimeric protein binds a nucleic acid sequence within the nucleic acid target sequence to process by said first and second monomers previously described. In other words, said third chimeric protein can have a binding sequence within the spacer separating the first and a second nucleic acid sequences recognized and bound by the first and second monomers of the chimeric dimer protein according to the invention. In another embodiment, said third chimeric protein comprises a protein domain with a catalytic activity to process nucleic acid target sequence that is different from that of the catalytically active entity formed by the protein subdomains of respective first and second monomers of the chimeric dimer protein according to the present invention. As non-limiting example, first and second monomer protein subdomains can form a catalytically active entity with a cleavase activity towards the nucleic acid target sequence and said third chimeric protein can comprise a protein domain with an exonuclease activity to increase the mutagenesis rate a the nucleic acid target sequence location. In another embodiment, said third chimeric protein binds a nucleic acid sequence located 5' regarding the nucleic acid target sequence to process by said first and second monomers previously described. In another embodiment, said third chimeric protein binds a nucleic acid sequence located 3' regarding the nucleic acid target sequence to process by said first and second monomers previously described.

In another embodiment said chimeric dimer protein according to the present invention can be associated with a core scaffold comprising a set of Repeat Variable Dipeptide regions (RVDs) able to bind a nucleic acid sequence adjacent to a nucleic acid target sequence to process wherein each RVD comprises a pair of amino acids responsible for recognizing one nucleotide selected from the group consisting of HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A, YG for recognizing T, TL for recognizing A, VT for recognizing A or G, SW for recognizing A, N* for recognizing C or T and H* for recognizing T (where * denotes a gap in the repeat sequence that corresponds to a lack of amino acid residue at the second position of the RVD). In other words, said core scaffold associated with said chimeric dimer protein according to the present invention can have a binding sequence within the spacer separating the first and a second nucleic acid sequences recognized and bound by the first and second monomers of the chimeric dimer protein according to the invention. In another embodiment, said core scaffold associated with said chimeric dimer protein according to the present invention allows to control the processing activity of said chimeric dimer protein according to the present invention on its nucleic acid target sequence. In other words, said core scaffold associated with said chimeric dimer protein according to the present invention allows to block the access of said chimeric dimer protein according to the present invention on its nucleic acid target sequence. In another embodiment, the expression of said core scaffold to control the processing activity of said chimeric dimer protein can be a cell-cycle or tissue dependent expression, allowing a cell-cycle or tissue dependent control of said chimeric dimer protein activity towards its nucleic acid target sequence. Such a blocking core scaffold can also be used in combination with a chimeric protein according to the invention wherein said core scaffold binds the nucleic acid target sequence of said chimeric protein according to the invention to allow a control, a cell-cycle or time dependent control of said chimeric protein activity towards its nucleic acid sequence.

In another embodiment, said chimeric protein according to the present invention can function as a trimer wherein a third monomer is derived from a Transcription Activator-Like Effector (TALE) and comprises:

(i) A core scaffold comprising a set of Repeat Variable Dipeptide regions (RVDs) able to bind a nucleic acid sequence adjacent to a nucleic acid target sequence to process wherein each RVD comprises a pair of amino acids responsible for recognizing one nucleotide selected from the group consisting of HD for recognizing C, NG for recognizing T, NI for recognizing A, NN for recognizing G or A, NS for recognizing A, C, G or T, HG for recognizing T, IG for recognizing T, NK for recognizing G, HA for recognizing C, ND for recognizing C, HI for recognizing C, HN for recognizing G, NA for recognizing G, SN for recognizing G or A and YG for recognizing T, TL for recognizing A, VT for recognizing A or G and SW for recognizing A.

(ii) A protein domain part of a catalytic entity able to process said nucleic acid target sequence;

thereby obtaining a chimeric protein or a chimeric trimer protein that is a comprising a catalytic entity able to process said nucleic acid target sequence.

Said third monomer core can have the same scope of characteristics that those previously listed to describe a chimeric protein according to the present invention, regarding the origin of said core scaffold, the number of RVDs comprised in said core scaffold, the nature of those RVDs (natural, artificial or RVDs-like domains), the existence of additional N-terminus or C-terminus or both domains on this core scaffold, the existence of one or several localization signals on this core scaffold, the existence of one or several peptidic linkers on this core scaffold to fuse one or several protein domains on this core scaffold and the nature and characteristics of its protein(s) domain(s) or subdomain(s).

In another embodiment, said third monomer binds a nucleic acid sequence within the nucleic acid target sequence to process by said first and second monomers previously described. In other words, said third monomer can have a binding sequence within the spacer separating the first and a second nucleic acid sequences recognized and bound by the first and second monomers of the chimeric trimer protein according to the invention. In another embodiment, said third monomer binds a nucleic acid sequence located 5' regarding the nucleic acid target sequence to process by said first and second monomers previously described. In another embodiment, said third monomer binds a nucleic acid sequence located 3' regarding the nucleic acid target sequence to process by said first and second monomers previously described.

In another embodiment, said third protein subdomain can be used to measure, quantify or provoke protein-protein interactions at said nucleic target sequence according to the present invention. Said third protein subdomain can be a protein module or protein subdomain known to mediate protein-protein interaction in cell signaling. Said third protein subdomain can be used for diagnosis, analytical or therapeutic applications. Said third protein subdomain can be usable for applications such as Fluorescence Resonance Energy Transfer (FRET) as non-limiting example. In another preferred embodiment, said third protein subdomain is usable in FRET as a donor molecule, subdomains of first and second monomers being successive and compatible acceptor molecules. In another preferred embodiment, said third protein subdomain is usable in FRET as an acceptor molecule, one of the subdomains of first and second monomers being respectively successive and compatible donor and acceptor molecules. Said third protein subdomain can be coupled to a dye. In other words, first, second and third subdomains of respective monomers constituting the chimeric trimer protein according to the invention can be a successive and compatible trio of "dyes" usable in FRET applications, more specific than the usual FRET applications using two successive and compatible dyes.

In another aspect of the invention, is also encompassed a recombinant polynucleotide encoding a chimeric protein or a monomer of a chimeric dimer protein as previously described according to the present invention.

Is also encompassed a vector comprising a recombinant polynucleotide encoding a chimeric protein or a monomer of a chimeric dimer protein as previously described according to the present invention.

Is also encompassed a host cell which comprises a vector and/or a recombinant polynucleotide encoding a chimeric protein or a monomer of a chimeric dimer protein as previously described according to the present invention.

Is also encompassed in the scope of the present invention a non-human transgenic animal comprising a vector and/or a recombinant polynucleotide encoding a chimeric protein or a monomer of a chimeric dimer protein as previously described according to the present invention.

Is also encompassed in the scope of the present invention a transgenic plant comprising a vector and/or a recombinant polynucleotide encoding a chimeric protein or a monomer of a chimeric dimer protein as previously described according to the present invention.

The present invention also relates to a kit comprising a chimeric protein or a monomer of a chimeric dimer protein according to the present invention or a vector and/or a recombinant polynucleotide encoding a chimeric protein or a monomer of a chimeric dimer protein as previously described according to the present invention and instructions for use said kit.

The present invention also relates to a composition comprising a chimeric protein or a monomer of a chimeric dimer protein according to the present invention or a vector and/or a recombinant polynucleotide encoding a chimeric protein or a monomer of a chimeric dimer protein as previously described according to the present invention and a carrier. More preferably, is a pharmaceutical composition comprising a chimeric protein or a monomer of a chimeric dimer protein according to the present invention or a vector and/or a recombinant polynucleotide encoding a chimeric protein or a monomer of a chimeric dimer protein as previously described according to the present invention and a pharmaceutically active carrier.

For purposes of therapy, the chimeric protein or a monomer of a chimeric dimer protein according to the present invention and a pharmaceutically acceptable excipient are administered in a therapeutically effective amount. Such a combination is said to be administered in a "therapeutically effective amount" if the amount administered is physiologically significant. An agent is physiologically significant if its presence results in a detectable change in the physiology of the recipient. In the present context, an agent is physiologically significant if its presence results in a decrease in the severity of one or more symptoms of the targeted disease and in a genome correction of the lesion or abnormality. Vectors comprising targeting DNA and/or nucleic acid encoding chimeric protein or a monomer of a chimeric dimer protein according to the present invention can be introduced into a cell by a variety of methods (e.g., injection, direct uptake, projectile bombardment, liposomes, electroporation). Chimeric proteins or monomers of chimeric dimer proteins according to the present invention can be stably or transiently expressed into cells using expression vectors. Techniques of expression in eukaryotic cells are well known to those in the art. (See Current Protocols in Human Genetics: Chapter 12 "Vectors For Gene Therapy" & Chapter 13 "Delivery Systems for Gene Therapy").

In one further aspect of the present invention, the chimeric protein or a monomer of a chimeric dimer protein according to the present invention is substantially non-immunogenic, i.e., engender little or no adverse immunological response. A variety of methods for ameliorating or eliminating deleterious immunological reactions of this sort can be used in accordance with the invention. In a preferred embodiment, the chimeric protein or a monomer of a chimeric dimer protein according to the present invention is substantially free of N-formyl methionine. Another way to avoid unwanted immunological reactions is to conjugate the chimeric protein or a monomer of a chimeric dimer protein according to the present invention to polyethylene glycol ("PEG") or polypropylene glycol ("PPG") (preferably of 500 to 20,000 daltons average molecular weight (MW)). Conjugation with PEG or PPG, as described by Davis et al. (U.S. Pat. No. 4,179,337) for example, can provide non-immunogenic, physiologically active, water soluble chimeric proteins or monomers of chimeric dimer proteins conjugates with anti-viral activity. Similar methods also using a polyethylene-polypropylene glycol copolymer are described in Saifer et al. (U.S. Pat. No. 5,006,333).

The present invention also relates to methods for use of said chimeric protein or a monomer of a chimeric dimer protein according to the invention for various applications ranging from targeted DNA cleavage to targeted gene regulation. Depending on their structures and particularly the nature [transcription regulator, protein interacting with or modifying other proteins, catalytical activities such as nuclease activity (endonuclease and exonuclease), polymerase activity, kinase activity, phosphatase activity, methylase activity, topoisomerase activity, integrase activity, transposase activity, ligase activity, helicase activity, recombinase activity], the number and the combinations of several protein domains fused to said core scaffold, chimeric protein or a monomer of a chimeric dimer protein according to the present invention allow to achieve and facilitate DNA processing activities such as creating or modifying epigenetic regulatory elements, making site-specific insertions, deletions, or repairs in nucleic acid, controlling gene expression, and modifying chromatin structure, as non-limiting examples.

In a preferred embodiment, the present invention relates to a method for increasing targeted HR (and mutagenesis via NHEJ) when Double-Strand break activity is promoted in a chimeric protein or a monomer of a chimeric dimer protein according to the present invention targeting a DNA target sequence according to the invention. In another more preferred embodiment, the addition of at least two catalytically active cleavase domains according to the invention allows to increase Double-strand break-induced mutagenesis by leading to a loss of genetic information and preventing any scarless re-ligation of targeted genomic locus of interest by NHEJ.

In another preferred embodiment, the present invention relates to a method for increasing targeted HR in a more conservative fashion (with less mutagenesis via NHEJ) when Single-Strand Break activity is promoted in a chimeric protein or a monomer of a chimeric dimer protein according to the present invention targeting a DNA target sequence according to the invention.

In another preferred embodiment, the present invention relates to a method for increasing excision of a single-strand of DNA spanning the binding region of a chimeric protein or a monomer of a chimeric dimer protein according to the present invention when both one cleavase enhancer domain and one nickase enhancer domain, respectively, are fused to both N-terminus and C-terminus of at least one of the core scaffold of a chimeric protein or a monomer of a chimeric dimer protein according to the present invention.

In another preferred embodiment, the present invention relates to a method for treatment of a genetic disease caused by a mutation in a specific single double-stranded DNA target sequence in a gene, comprising administering to a subject in need thereof an effective amount of a chimeric protein or a monomer of a chimeric dimer protein, according to the present invention, a functional mutant, a variant or a derivative thereof. In a more preferred embodiment, said chimeric protein, a functional mutant, a variant or a derivative thereof for treatment of a genetic disease is independent of single-nucleotide polymorphisms (SNPs) that occur in the respective genomes of subjects in need thereof, due to TALE code degeneracy. In other words, the present invention relates to a method for treatment of a genetic disease caused by a mutation in a nucleic acid target sequence, comprising administering to a subject in need thereof, in order to cure said genetic disease, an effective amount of a chimeric protein or a monomer of a chimeric dimer protein, according to the present invention, a functional mutant, a variant or a derivative thereof wherein said chimeric protein overcomes the genomic variations of subjects due to SNPs. Said method of the present invention allows the treatment of said genetic disease by constructing and administering one unique chimeric protein according to the invention to every subjects in need thereof, whatever SNPs profiles around said mutation responsible for genetic disease in these subjects. Hence, said method of the present invention avoids the need to construct and administer one personalized chimeric protein for each subject in need thereof that takes into account each SNP profile around the mutation to cure. As non-limiting example, said unique chimeric protein to cure said genetic disease according to the present invention can comprise degenerated RVDs in its core scaffold such as NN for recognizing G or A, NS for recognizing A, C, G or T or SN for recognizing G or A. As another non-limiting example, in the case where a genomic mutation responsible for a genetic disease is closed to a G/A SNPs variation, said method of the present invention allows to treat this genetic disease by constructing and administering a unique chimeric protein according to the present invention wherein said core scaffold of said chimeric protein comprises a SN-type RVD for recognizing either G, either A, present in the genome of every subjects at SNPs location, in order to bind said genomic sequence around said SNP and treat said genetic disease. In another embodiment, said method can be used to overcome interspecies sequence variations.

In another preferred embodiment, the present invention relates to a method for inserting a transgene into a specific single double-stranded DNA target sequence of a genomic locus of a cell, tissue or non-human animal, or a plant wherein at least one chimeric protein or a monomer of a chimeric dimer protein of the present invention is transitory or not introduced into said cell, tissue, non-human animal or plant.

In another embodiment, the present invention relates to a method for optimizing the control of nucleic acid processing activity of a chimeric protein (or a monomer of a chimeric dimer protein according to the present invention) within its nucleic acid target sequence. In a preferred embodiment, the present invention relates to a method for optimizing the control of nucleic acid processing activity of a chimeric protein (or a monomer of a chimeric dimer protein according to the present invention) within its nucleic acid target sequence by associating an optimum core scaffold structure to an optimum spacer length. In a preferred embodiment, the present invention relates to a method for optimizing the control of nucleic acid processing activity of a chimeric protein (or a monomer of a chimeric dimer protein according to the present invention) within its nucleic acid target sequence by associating an optimum C-terminal truncation of the core scaffold structure to an optimum spacer length. In a preferred embodiment, the present invention relates to a method for optimizing the control of nucleic acid processing activity of a chimeric protein (or a monomer of a chimeric dimer protein according to the present invention) within its nucleic acid target sequence by associating an optimum N-terminal truncation of the core scaffold structure to an optimum spacer length. In a preferred embodiment, the present invention relates to a method for optimizing the control of nucleic acid processing activity of a chimeric protein (or a monomer of a chimeric dimer protein according to the present invention) within its nucleic acid target sequence by associating two optimum C-terminal truncations of the core scaffold structure to an optimum spacer length as illustrated on FIGS. 10 and 11. In a preferred embodiment, the present invention relates to a method for optimizing the control of nucleic acid processing activity of a chimeric protein (or a monomer of a chimeric dimer protein according to the present invention) within its nucleic acid target sequence by associating two optimum N-terminal truncations of the core scaffold structure to an optimum spacer length.

In a preferred embodiment, the present invention relates to a method for optimizing the control of double-stranded break activity of a chimeric protein (or a monomer of a chimeric dimer protein according to the present invention) within its nucleic acid target sequence. In a preferred embodiment, the present invention relates to a method for optimizing the control of double-stranded break activity of a chimeric protein (or a monomer of a chimeric dimer protein according to the present invention) within its nucleic acid target sequence by associating an optimum core scaffold structure to an optimum spacer length. In a preferred embodiment, the present invention relates to a method for optimizing the control of double-stranded break activity of a chimeric protein (or a monomer of a chimeric dimer protein according to the present invention) within its nucleic acid target sequence by associating an optimum C-terminal truncation of the core scaffold structure to an optimum spacer length. In a preferred embodiment, the present invention relates to a method for optimizing the control of double-stranded break activity of a chimeric protein (or a monomer of a chimeric dimer protein according to the present invention) within its nucleic acid target sequence by associating two optimum C-terminal truncations of the core scaffold structure to an optimum spacer length. In a preferred embodiment, the present invention relates to a method for optimizing the control of double-stranded break activity of a chimeric protein (or a monomer of a chimeric dimer protein according to the present invention) within its nucleic acid target sequence by associating two different optimum C-terminal truncations of the core scaffold structure to an optimum spacer length.

In a preferred embodiment, the present invention relates to a method for optimizing the control of double-stranded break activity of a chimeric protein (or a monomer of a chimeric dimer protein according to the present invention) within its nucleic acid target sequence by associating an optimum N-terminal truncation of the core scaffold structure to an optimum spacer length. In a preferred embodiment, the present invention relates to a method for optimizing the control of double-stranded break activity of a chimeric protein (or a monomer of a chimeric dimer protein according to the present invention) within its nucleic acid target sequence by associating two optimum N-terminal truncations of the core scaffold structure to an optimum spacer length. In a preferred embodiment, the present invention relates to a method for optimizing the control of double-stranded break activity of a chimeric protein (or a monomer of a chimeric dimer protein according to the present invention) within its nucleic acid target sequence by associating two different optimum N-terminal truncations of the core scaffold structure to an optimum spacer length.

In other words, the present invention relates to a method for increasing the number of targets that can be reach by a chimeric protein of the present invention, in a locus of a given genome, by associating to a spacer length imposed by the sequence of said locus of a given genome an optimal C-terminal truncation of the core scaffold of said chimeric protein as illustrated on FIG. 11.

In another embodiment, the present invention relates to a method for increasing the number of targets that can be reach by a chimeric protein of the present invention, in a locus of a given genome, by associating to a spacer length imposed by the sequence of said locus of a given genome an optimal C-terminal truncation of the core scaffold of said chimeric protein, wherein said spacer length can be comprised between 5 and 40 bp. In another embodiment, the present invention relates to a method for increasing the number of targets that can be reach by a chimeric protein of the present invention, in a locus of a given genome, by associating to a spacer length imposed by the sequence of said locus of a given genome an optimal C-terminal truncation of the core scaffold of said chimeric protein, wherein said spacer length can be comprised between 8 and 40 bp.

In another embodiment, the present invention relates to a method for increasing the number of targets that can be reach by a chimeric protein of the present invention, in a locus of a given genome, by associating to a spacer length imposed by the binding site within said locus an optimal C-terminal truncation of the core scaffold of said chimeric protein. In a preferred embodiment, the present invention relates to a method for increasing the number of targets that can be reach by a chimeric protein of the present invention, in a locus of a given genome, by associating to a spacer length imposed by the binding site within said locus, wherein said sequence of said locus is poor in T, an optimal C-terminal truncation of the core scaffold of said chimeric protein.

In a preferred embodiment, the present invention relates to a method for optimizing the control of double-stranded break location of a chimeric protein (or a monomer of a chimeric dimer protein according to the present invention) within its nucleic acid target sequence by associating two optimum C-terminal truncations of the core scaffold structure to an optimum spacer length wherein said association allows placing the cleavage site at a more desired location within said spacer as illustrated on FIG. 10. In another embodiment, said association between two optimum C-terminal truncations of the core scaffold structure and an optimum spacer length allows placing the cleavage site at a more desired location that is not in the center of said spacer as illustrated on FIG. 10 B and C. In another embodiment, said association between two optimum C-terminal truncations of the core scaffold structure and an optimum spacer length allows placing the cleavage site at a more desired location that is in the left part (i.e 5' located regarding the center of the spacer) of said spacer as illustrated on FIG. 10 C. In another embodiment, said association between two optimum C-terminal truncations of the core scaffold structure and an optimum spacer length allows placing the cleavage site at a more desired location that is in the right part (i.e 3' located regarding the center of the spacer) of said spacer as illustrated on FIG. 10 B. In another embodiment, said association between two optimum C-terminal truncations of the core scaffold structure and an optimum spacer length allows placing the cleavage site at the center of said spacer as illustrated on FIG. 10 A.

In another embodiment, the present invention relates to a method for increasing the number of targets that can be reach by a chimeric protein of the present invention, in a locus of a given genome, by associating to a spacer length imposed by the sequence of said locus of a given genome an optimal N-terminal truncation of the core scaffold of said chimeric protein.

In another embodiment, the present invention relates to a method for increasing the number of targets that can be reach by a chimeric protein of the present invention, in a locus of a given genome, by associating to a spacer length imposed by the sequence of said locus of a given genome an optimal N-terminal truncation of the core scaffold of said chimeric protein, wherein said spacer length can be comprised between 5 and 40 bp. In another embodiment, the present invention relates to a method for increasing the number of targets that can be reach by a chimeric protein of the present invention, in a locus of a given genome, by associating to a spacer length imposed by the sequence of said locus of a given genome an optimal N-terminal truncation of the core scaffold of said chimeric protein, wherein said spacer length can be comprised between 8 and 40 bp.

In another embodiment, the present invention relates to a method for increasing the number of targets that can be reach by a chimeric protein of the present invention, in a locus of a given genome, by associating to a spacer length imposed by the binding site within said locus an optimal N-terminal truncation of the core scaffold of said chimeric protein. In a preferred embodiment, the present invention relates to a method for increasing the number of targets that can be reach by a chimeric protein of the present invention, in a locus of a given genome, by associating to a spacer length imposed by the binding site within said locus, wherein said sequence of said locus is poor in T, an optimal N-terminal truncation of the core scaffold of said chimeric protein.

In a preferred embodiment, the present invention relates to a method for optimizing the control of double-stranded break location of a chimeric protein (or a monomer of a chimeric dimer protein according to the present invention) within its nucleic acid target sequence by associating two optimum N-terminal truncations of the core scaffold structure to an optimum spacer length wherein said association allows placing the cleavage site at a more desired location within said spacer. In another embodiment, said association between two optimum N-terminal truncations of the core scaffold structure and an optimum spacer length allows placing the cleavage site at a more desired location that is not in the center of said spacer. In another embodiment, said association between two optimum N-terminal truncations of the core scaffold structure and an optimum spacer length allows placing the cleavage site at a more desired location that is in the left part (i.e 5' located regarding the center of the spacer) of said spacer. In another embodiment, said association between two optimum N-terminal truncations of the core scaffold structure and an optimum spacer length allows placing the cleavage site at a more desired location that is in the right part (i.e 3' located regarding the center of the spacer) of said spacer. In another embodiment, said association between two optimum N-terminal truncations of the core scaffold structure and an optimum spacer length allows placing the cleavage site at the center of said spacer.

In another embodiment, the present invention relates to a method for optimizing the control of nucleic acid processing activity, the double-stranded break activity of a chimeric protein (or a monomer of a chimeric dimer protein according to the present invention) within its nucleic acid target sequence, by respectively associating two optimum N-terminal and C-terminal truncations of the core scaffold structure to an optimum spacer length.

In another embodiment, the present invention relates to a method for optimizing the control of double-stranded break location of a chimeric protein (or a monomer of a chimeric dimer protein according to the present invention) within its nucleic acid target sequence by respectively associating two optimum N-terminal and C-terminal truncations of the core scaffold structure to an optimum spacer length wherein said association allows placing the cleavage site at a more desired location within said spacer Other Definitions Amino acid residues in a polypeptide sequence are designated herein according to the one-letter code, in which, for example, Q means Gln or Glutamine residue, R means Arg or Arginine residue and D means Asp or Aspartic acid residue.

Amino acid substitution means the replacement of one amino acid residue with another, for instance the replacement of an Arginine residue with a Glutamine residue in a peptide sequence is an amino acid substitution.

DNA or nucleic acid processing activity refers to a particular/given enzymatic activity of a protein domain comprised in a chimeric protein according to the invention such as in the expression "a protein domain to process said nucleic acid target sequence". Said DNA or nucleic acid processing activity can refer to a cleavage activity, either a cleavase activity either a nickase activity, more broadly a nuclease activity but also a polymerase activity, a kinase activity, a phosphatase activity, a methylase activity, a topoisomerase activity, an integrase activity, a transposase activity, a ligase, a helicase or recombinase activity as non-limiting examples.

Nucleotides are designated as follows: one-letter code is used for designating the base of a nucleoside: a is adenine, t is thymine, c is cytosine, and g is guanine. For the degenerated nucleotides, r represents g or a (purine nucleotides), k represents g or t, s represents g or c, w represents a or t, m represents a or c, y represents t or c (pyrimidine nucleotides), d represents g, a or t, v represents g, a or c, b represents g, t or c, h represents a, t or c, and n represents g, a, t or c.

by "variant", "chimeric protein variant" or "TALEN variant", it is intended a chimeric protein, a chimeric protein derived from a Transcription Activator-like Effector (TALE) or a TALEN obtained by replacement of at least one residue in the amino acid sequence of the parent chimeric protein, parent chimeric protein derived from a Transcription Activator-like Effector (TALE) or parent TALEN with at least a different amino acid.

by "peptide linker" or "peptidic linker" it is intended to mean a peptide sequence which allows the connection of different monomers or different parts comprised in a fusion protein such as between a core scaffold and a protein domain in a chimeric protein according to the present invention and which allows the adoption of a correct conformation for said fusion protein activity and/or specificity. Peptide linkers can be of various sizes, from 3 amino acids to 50 amino acids as a non limiting indicative range. Peptide linkers can also be qualified as structured or unstructured. Peptide linkers can be qualified as active linkers when they comprise active domains that are able to change their structural conformation under appropriate stimulation.

by "related to", particularly in the expression "one cell type related to the chosen cell type or organism", is intended a cell type or an organism sharing characteristics with said chosen cell type or said chosen organism; this cell type or organism related to the chosen cell type or organism, can be derived from said chosen cell type or organism or not.

by "subdomain" it is intended a protein subdomain or a protein part that interacts with another protein subdomain or protein part to form an active entity and/or a catalytic active entity possibly bearing nucleic acid or DNA processing activity of said chimeric protein according to the invention.

by "targeting DNA construct/minimal repair matrix/repair matrix" it is intended to mean a DNA construct comprising a first and second portion that are homologous to regions 5' and 3' of the DNA target in situ. The DNA construct also comprises a third portion positioned between the first and second portion which comprise some homology with the corresponding DNA sequence in situ or alternatively comprise no homology with the regions 5' and 3' of the DNA target in situ. Following cleavage of the DNA target, a homologous recombination event is stimulated between the genome containing the targeted gene comprised in the locus of interest and the repair matrix, wherein the genomic sequence containing the DNA target is replaced by the third portion of the repair matrix and a variable part of the first and second portions of the repair matrix.

by "functional mutant" is intended a catalytically active mutant of a protein or a protein domain; such mutant can have the same activity compared to its parent protein or protein domain or additional properties. This definition applies to chimeric proteins or protein domains that constitute chimeric proteins according to the present invention. Are also encompassed in the scope of this definition "derivatives" of these proteins or protein domains that comprise the entirety or part of these proteins or protein domains fused to other proteic or chemical parts such as tags, antibodies, polyethylene glycol as non-limiting examples.

The expression "single polypeptide chain" is used to qualify a chimeric protein according to the invention which functions as a dimer wherein one first monomer and one second monomer are fused by a peptidic linker.

by "DNA target", "DNA target sequence", "target DNA sequence", "nucleic acid target sequence", "target sequence" , or "processing site" is intended a polynucleotide sequence that can be processed by a chimeric protein according to the present invention. These terms refer to a specific DNA location, preferably a genomic location in a cell, but also a portion of genetic material that can exist independently to the main body of genetic material such as plasmids, episomes, virus, transposons or in organelles such as mitochondria or chloroplasts as non-limiting examples. The nucleic acid target sequence is defined by the 5' to 3' sequence of one strand of said target, as indicate above for Avr15 (SEQ ID NO: 6) as a non-limiting example.

Adjacent is used to distinguish between 1) the nucleic acid sequence recognized and bound by a set of specific RVDs comprised in the core scaffold of said chimeric protein according to the invention and 2) the nucleic acid target sequence to be processed by said chimeric protein according to the invention, said nucleic sequences 1) and 2) being adjacent. When said chimeric protein according to the invention functions as a dimer comprising respectively two monomers, the term adjacent is equally used to qualify the nucleic acid target sequence regarding the first nucleic acid sequence recognized and bound by the first monomer and to qualify the nucleic acid target sequence regarding the second nucleic acid sequence recognized and bound by the second monomer. By the nucleic acid sequence adjacent to the nucleic acid target sequence is meant the recognition/binding site of said chimeric protein according to the invention.

By " delivery vector" or " delivery vectors" is intended any delivery vector which can be used in the present invention to put into cell contact (i.e "contacting") or deliver inside cells or subcellular compartments agents/chemicals and molecules (proteins or nucleic acids) needed in the present invention. It includes, but is not limited to liposomal delivery vectors, viral delivery vectors, drug delivery vectors, chemical carriers, polymeric carriers, lipoplexes, polyplexes, dendrimers, microbubbles (ultrasound contrast agents), nanoparticles, emulsions or other appropriate transfer vectors. These delivery vectors allow delivery of molecules, chemicals, macromolecules (genes, proteins), or other vectors such as plasmids, peptides developed by Diatos. In these cases, delivery vectors are molecule carriers. By "delivery vector" or "delivery vectors" is also intended delivery methods to perform transfection.

The terms "vector" or "vectors" refer to a nucleic acid molecule capable of transporting another nucleic acid to which it has been linked. A "vector" in the present invention includes, but is not limited to, a viral vector, a plasmid, a RNA vector or a linear or circular DNA or RNA molecule which may consists of a chromosomal, non chromosomal, semi-synthetic or synthetic nucleic acids. Preferred vectors are those capable of autonomous replication (episomal vector) and/or expression of nucleic acids to which they are linked (expression vectors). Large numbers of suitable vectors are known to those of skill in the art and commercially available.

Viral vectors include retrovirus, adenovirus, parvovirus (e. g. adenoassociated viruses), coronavirus, negative strand RNA viruses such as orthomyxovirus (e. g., influenza virus), rhabdovirus (e. g., rabies and vesicular stomatitis virus), paramyxovirus (e. g. measles and Sendai), positive strand RNA viruses such as picornavirus and alphavirus, and double-stranded DNA viruses including adenovirus, herpesvirus (e. g., Herpes Simplex virus types 1 and 2, Epstein-Barr virus, cytomega-lovirus), and poxvirus (e. g., vaccinia, fowlpox and canarypox). Other viruses include Norwalk virus, togavirus, flavivirus, reoviruses, papovavirus, hepadnavirus, and hepatitis virus, for example. Examples of retroviruses include: avian leukosis-sarcoma, mammalian C-type, B-type viruses, D type viruses, HTLV-BLV group, lentivirus, spumavirus (Coffin, J. M., Retroviridae: The viruses and their replication, In Fundamental Virology, Third Edition, B. N. Fields, et al., Eds., Lippincott-Raven Publishers, Philadelphia, 1996).

By "lentiviral vector" is meant HIV-Based lentiviral vectors that are very promising for gene delivery because of their relatively large packaging capacity, reduced immunogenicity and their ability to stably transduce with high efficiency a large range of different cell types. Lentiviral vectors are usually generated following transient transfection of three (packaging, envelope and transfer) or more plasmids into producer cells. Like HIV, lentiviral vectors enter the target cell through the interaction of viral surface glycoproteins with receptors on the cell surface. On entry, the viral RNA undergoes reverse transcription, which is mediated by the viral reverse transcriptase complex. The product of reverse transcription is a double-stranded linear viral DNA, which is the substrate for viral integration in the DNA of infected cells.

By "integrative lentiviral vectors (or LV)", is meant such vectors as non limiting example, that are able to integrate the genome of a target cell.

At the opposite by "non integrative lentiviral vectors (or NILV)" is meant efficient gene delivery vectors that do not integrate the genome of a target cell through the action of the virus integrase.

One type of preferred vector is an episome, i.e., a nucleic acid capable of extra-chromosomal replication. Preferred vectors are those capable of autonomous replication and/or expression of nucleic acids to which they are linked. Vectors capable of directing the expression of genes to which they are operatively linked are referred to herein as "expression vectors. A vector according to the present invention comprises, but is not limited to, a YAC (yeast artificial chromosome), a BAC (bacterial artificial), a baculovirus vector, a phage, a phagemid, a cosmid, a viral vector, a plasmid, a RNA vector or a linear or circular DNA or RNA molecule which may consist of chromosomal, non chromosomal, semi-synthetic or synthetic DNA. In general, expression vectors of utility in recombinant DNA techniques are often in the form of "plasmids" which refer generally to circular double stranded DNA loops which, in their vector form are not bound to the chromosome. Large numbers of suitable vectors are known to those of skill in the art. Vectors can comprise selectable markers, for example: neomycin phosphotransferase, histidinol dehydrogenase, dihydrofolate reductase, hygromycin phosphotransferase, herpes simplex virus thymidine kinase, adenosine deaminase, glutamine synthetase, and hypoxanthine-guanine phosphoribosyl transferase for eukaryotic cell culture; TRP1 for *S. cerevisiae*; tetracyclin, rifampicin or ampicillin resistance in *E. coli*. Preferably said vectors are expression vectors, wherein a sequence encoding a polypeptide of interest is placed under control of appropriate transcriptional and translational control elements to permit production or synthesis of said polypeptide. Therefore, said polynucleotide is comprised in an expression cassette. More particularly, the vector comprises a replication origin, a promoter operatively linked to said encoding polynucleotide, a ribosome binding site, a RNA-splicing site (when genomic DNA is used), a polyadenylation site and a transcription termination site. It also can comprise an enhancer or silencer elements. Selection of the promoter will depend upon the cell in which the polypeptide is expressed. Suitable promoters include tissue specific and/or inducible promoters. Examples of inducible promoters are: eukaryotic metallothionine promoter which is induced by increased levels of heavy metals, prokaryotic IacZ promoter which is induced in response to isopropyl-β-D-thiogalacto-pyranoside (IPTG) and eukaryotic heat shock promoter which is induced by increased temperature. Examples of tissue specific promoters are skeletal muscle creatine kinase, prostate-specific antigen (PSA), α-antitrypsin protease, human surfactant (SP) A and B proteins, β-casein and acidic whey protein genes.

Inducible promoters may be induced by pathogens or stress, more preferably by stress like cold, heat, UV light, or high ionic concentrations (reviewed in Potenza C et al. 2004, In vitro Cell Dev Biol 40:1-22). Inducible promoter may be induced by chemicals (reviewed in (Moore, Samalova et al. 2006); (Padidam 2003); (Wang, Zhou et al. 2003); (Zuo and Chua 2000).

Delivery vectors and vectors can be associated or combined with any cellular permeabilization techniques such as sonoporation or electroporation or derivatives of these techniques.

By cell or cells is intended any prokaryotic or eukaryotic living cells, cell lines derived from these organisms for in vitro cultures, primary cells from animal or plant origin.

By "primary cell" or "primary cells" are intended cells taken directly from living tissue (i.e. biopsy material) and established for growth in vitro, that have undergone very few population doublings and are therefore more representative of the main functional components and characteristics of tissues from which they are derived from, in comparison to continuous tumorigenic or artificially immortalized cell lines. These cells thus represent a more valuable model to the in vivo state they refer to.

In the frame of the present invention, "eukaryotic cells" refer to a fungal, plant or animal cell or a cell line derived from the organisms listed below and established for in vitro culture. More preferably, the fungus is of the genus Aspergillus, Penicillium, Acremonium, Trichoderma, Chrysoporium, Mortierella, Kluyveromyces or Pichia; More preferably, the fungus is of the species Aspergillus niger, Aspergillus nidulans, Aspergillus oryzae, Aspergillus terreus, Penicillium chrysogenum, Penicillium citrinum, Acremonium Chrysogenum, Trichoderma reesei, Mortierella alpine, Chrysosporium lucknowense, Kluyveromyces lactis, Pichia pastoris or Pichia ciferrii.

More preferably the plant is of the genus Arabidospis, Nicotiana, Solanum, lactuca, Brassica, Oryza, Asparagus, Pisum, Medicago, Zea, Hordeum, Secale, Triticum, Capsicum, Cucumis, Cucurbita, Citrullis, Citrus, Sorghum; More preferably, the plant is of the species Arabidospis thaliana, Nicotiana tabaccum, Solanum lycopersicum, Solanum tuberosum, Solanum melongena, Solanum esculentum, Lactuca saliva, Brassica napus, Brassica oleracea, Brassica rapa, Oryza glaberrima, Oryza sativa, Asparagus officinalis, Pisum sativum, Medicago sativa, zea mays, Hordeum vulgare, Secale cereal, Triticum aestivum, Triticum durum, Capsicum sativus, Cucurbita pepo, Citrullus lanatus, Cucumis melo, Citrus aurantifolia, Citrus maxima, Citrus medica, Citrus reticulata.

More preferably the animal cell is of the genus Homo, Rattus, Mus, Sus, Bos, Danio, Canis, Felis, Equus, Salmo, Oncorhynchus, Gallus, Meleagris, Drosophila, Caenorhabditis; more preferably, the animal cell is of the species Homo sapiens, Rattus norvegicus, Mus musculus, Sus scrofa, Bos taurus, Danio rerio, Canis lupus, Felis catus, Equus caballus, Salmo salar, Oncorhynchus mykiss, Gallus gallus, Meleagris gallopavo, Drosophila melanogaster, Caenorhabditis elegans.

In the present invention, the cell can be a plant cell, a mammalian cell, a fish cell, an insect cell or cell lines derived from these organisms for in vitro cultures or primary cells taken directly from living tissue and established for in vitro culture. As non limiting examples cell lines can be selected from the group consisting of CHO-K1 cells; HEK293 cells; Caco2 cells; U2-OS cells; NIH 3T3 cells; NSO cells; SP2 cells; CHO-S cells; DG44 cells; K-562 cells, U-937 cells; MRCS cells; IMR90 cells; Jurkat cells; HepG2 cells; HeLa cells; HT-1080 cells; HCT-116 cells; Hu-h7 cells; Huvec cells; Molt 4 cells.

All these cell lines can be modified by the method of the present invention to provide cell line models to produce, express, quantify, detect, study a gene or a protein of interest; these models can also be used to screen biologically active molecules of interest in research and production and various fields such as chemical, biofuels, therapeutics and agronomy as non-limiting examples.

by "homologous" is intended a sequence with enough identity to another one to lead to homologous recombination between sequences, more particularly having at least 95% identity, preferably 97% identity and more preferably 99%.

"identity" refers to sequence identity between two nucleic acid molecules or polypeptides. Identity can be determined by comparing a position in each sequence which may be aligned for purposes of comparison. When a position in the compared sequence is occupied by the same base, then the molecules are identical at that position. A degree of similarity or identity between nucleic acid or amino acid sequences is a function of the number of identical or matching nucleotides at positions shared by the nucleic acid sequences. Various alignment algorithms and/or programs may be used to calculate the identity between two sequences, including FASTA, or BLAST which are available as a part of the GCG sequence analysis package (University of Wisconsin, Madison, Wis.), and can be used with, e.g., default setting.

by "mutation" is intended the substitution, deletion, insertion of one or more nucleotides/amino acids in a polynucleotide (cDNA, gene) or a polypeptide sequence. Said mutation can affect the coding sequence of a gene or its regulatory sequence. It may also affect the structure of the genomic sequence or the structure/stability of the encoded mRNA.

In the frame of the present invention, the expression "double-strand break-induced mutagenesis" (DSB-induced mutagenesis) refers to a mutagenesis event consecutive to an NHEJ event following an endonuclease-induced DSB, leading to insertion/deletion at the cleavage site of an endonuclease.

By "gene" is meant the basic unit of heredity, consisting of a segment of DNA arranged in a linear manner along a chromosome, which codes for a specific protein or segment of protein. A gene typically includes a promoter, a 5' untranslated region, one or more coding sequences (exons), optionally introns, a 3' untranslated region. The gene may further comprise a terminator, enhancers and/or silencers.

As used herein, the term "transgene" refers to a sequence encoding a polypeptide. Preferably, the polypeptide encoded by the transgene is either not expressed, or expressed but not biologically active, in the cell, tissue or individual in which the transgene is inserted. Most preferably, the transgene encodes a therapeutic polypeptide useful for the treatment of an individual.

The term "gene of interest" or "GOI" refers to any nucleotide sequence encoding a known or putative gene product.

As used herein, the term "locus" is the specific physical location of a DNA sequence (e.g. of a gene) on a chromosome. The term "locus" usually refers to the specific physical location of a chimeric protein's nucleic target sequence on a chromosome. Such a locus, which comprises a target sequence that is recognized and cleaved by a chimeric protein according to the invention, is referred to as "locus according to the invention". Also, the expression "genomic locus of interest" is used to qualify a nucleic acid sequence in a genome that can be a putative target for a double-strand break according to the invention. It is understood that the considered genomic locus of interest of the present invention can not only qualify a nucleic acid sequence that exists in the main body of genetic material (i.e. in a chromosome) of a cell but also a portion of genetic material that can exist independently to said main body of genetic material such as plasmids, episomes, virus, transposons or in organelles such as mitochondria or chloroplasts as non-limiting examples.

By the expression "loss of genetic information" is understood the elimination or addition of at least one given DNA fragment (at least one nucleotide) or sequence within the intervening sequence between at least two processing sites of the chimeric protein of the present invention or between two chimeric proteins according to the present invention. This loss of genetic information can be, as a non-limiting example, the elimination of an intervening sequence between two processing sites of two chimeric proteins according to the present invention. As another non-limiting example, this loss of genetic information can also be an excision of a single-strand of DNA spanning the binding region of a chimeric protein according to the present invention By "scarless re-ligation" or "scarless religation" is intended the perfect re-ligation event, without loss of genetic information (no insertion/deletion events) of the DNA broken ends through NHEJ process after the creation of a double-strand break event.

By "Imprecise NHEJ" is intended the re-ligation of nucleic acid ends generated by a DSB, with insertions or deletions of nucleotides. Imprecise NHEJ is an outcome and not a repair pathway and can result from different NHEJ pathways (Ku dependent or Ku independent as non-limiting examples).

By "fusion protein" is intended the result of a well-known process in the art consisting in the joining of two or more genes which originally encode for separate proteins or part of them, the translation of said "fusion gene" resulting in a single polypeptide with functional properties derived from each of the original proteins.

By "chimeric protein" according to the present invention is meant any fusion protein comprising a core scaffold comprising a set of RVDs to bind a nucleic acid sequence and one protein domain to process a nucleic acid target sequence adjacent to said bound nucleic acid sequence. Said chimeric protein according to the present invention can function as a dimer wherein each monomer (a monomer of a chimeric dimer protein in this case) constituting said chimeric dimer protein comprises a set of RVDs to bind a nucleic acid sequence and one protein domain to process a nucleic acid target sequence adjacent to said bound nucleic acid sequence.

By "protein domain" or "catalytic domain" is meant the nucleic acid target sequence processing part of said chimeric protein according to the present invention. Said protein domain or catalytic domain can provide any catalytical activity as classified and named according to the reaction they catalyze [Enzyme Commission number (EC number) at http://www.chem.qmul.ac.uk/iubmb/enzyme/)]. Said protein domain or catalytic domain can be a catalytically active entity by itself. Said protein domain or catalytic domain can be a protein subdomain that needs to interact with another protein subdomain to form a dimeric protein domain active entity. From a chimeric dimer protein point of view according to the present invention, said protein domain or catalytic domain can be a first protein subdomain interacting with a second protein subdomain of another chimeric monomer protein according to the invention to form the catalytically active protein entity able to process the nucleic acid target sequence.

By a "TALE-nuclease" (TALEN) is intended a fusion protein consisting of a DNA-binding domain derived from a Transcription Activator Like Effector (TALE) and one nuclease catalytic domain to cleave a nucleic acid target sequence. Said TALEN is a subclass of chimeric protein according to the present invention.

By spacer is meant the nucleic acid area that separates the two nucleic acid sequences recognized and bound by each monomer constituting a chimeric dimer protein according to the invention. By spacer length is meant the nucleic acid distance that separates the two nucleic acid sequences recognized and bound by each monomer constituting a chimeric dimer protein according to the invention. According to the present invention, said nucleic acid target sequence of the chimeric protein according to the present invention can be encompassed in said spacer. Said nucleic acid target sequence of the chimeric protein according to the present invention can be identical to said spacer. Said nucleic acid target sequence of the chimeric protein according to the present invention can be different of said spacer.

The above written description of the invention provides a manner and process of making and using it such that any person skilled in this art is enabled to make and use the same, this enablement being provided in particular for the subject matter of the appended claims, which make up a part of the original description.

As used above, the phrases "selected from the group consisting of," "chosen from," and the like include mixtures of the specified materials.

Where a numerical limit or range is stated herein, the endpoints are included. Also, all values and subranges within a numerical limit or range are specifically included as if explicitly written out.

The above description is presented to enable a person skilled in the art to make and use the invention, and is provided in the context of a particular application and its requirements. Various modifications to the preferred embodiments will be readily apparent to those skilled in the art, and the generic principles defined herein may be applied to other embodiments and applications without departing from the spirit and scope of the invention. Thus, this invention is not intended to be limited to the embodiments shown, but is to be accorded the widest scope consistent with the principles and features disclosed herein.

Having generally described this invention, a further understanding can be obtained by reference to certain specific examples, which are provided herein for purposes of illustration only, and are not intended to be limiting unless otherwise specified.

EXAMPLES

Example 1

TAL Nuclease (TALEN) Activities in Yeast and Mammallan Cells

1.A: Activity in Yeast

The amino acid sequences of the N-terminal, C-terminal domains and RVDS were based on the AvrBs3 TAL (ref: GenBank: X16130.1, SEQ ID NO: 1).

The DNA encoding the N-terminal domain [referred as Nter wt or WT Nter (SEQ ID NO: 292), i.e. corresponding to the N terminal domain of natural AvrBs3 (SEQ ID NO: 1) except an Ala residue in position 2], the C-terminal domain [referred as Cter wt or WT Cter (SEQ ID NO: 400) lacking the activation domain of the C-terminal domain of natural AvrBs3 (SEQ ID NO: 1)] and the nuclease catalytic head were synthesized (TopGene Technologies) and subcloned into the pCLS0542 (SEQ ID NO: 2) yeast expression plasmid, using NcoI and EagI restriction enzymes, leading to the backbone plasmid pCLS7183 (referred as backbone wt, SEQ ID NO: 3). The C-terminal and the N-terminal domains are separated by two BsmBI restriction sites. The AvrBs3-derived set of repeat domains (RVDs) (SEQ ID NO: 4) was subcloned in the pCLS7183 using type IIs restriction enzymes BsmBI for the receiving plasmid and BbvI and SfaNI for the inserted RVD sequence, leading to pCLS7184 and subsequent AvrBs3-derived TALEN (referred as control wt, SEQ ID NO: 5). All the yeast target reporter plasmids containing the TALEN DNA target sequences were constructed as previously described (International PCT Applications WO 2004/067736 and in (Epinat, Arnould et al. 2003; Chames, Epinat et al. 2005; Arnould, Chames et al. 2006; Smith, Grizot et al. 2006). The AvrBs3-derived TALEN was tested at 30° C. in our yeast SSA assay previously described (International PCT Applications WO 2004/067736 and in (Epinat, Arnould et al. 2003; Chames, Epinat et al. 2005; Arnould, Chames et al. 2006; Smith, Grizot et al. 2006) as homodimer (two identical recognition sequences are placed facing each other on both DNA strands) on the target Avr15 (SEQ ID NO: 6, Table 3). TALEN cleavage activity levels on its respective target in yeast are shown on FIG. 2.

1.B: Activity in Mammalian Cells (CHO-K1)

The DNA encoding a HA tag, the N-terminal domain (referred as Nter wt), the C-terminal domain (referred as Cter wt) and the nuclease catalytic head were synthesized and subcloned into the pCLS1853 (SEQ ID NO: 7) mammalian expression plasmid, using AscI and XhoI restriction enzymes, leading to the backbone plasmid pCLS7111 (SEQ ID NO: 8). The C-terminal and the N-terminal domains are separated by two BsmBI restriction sites. The AvrBs3-derived set of repeat domains (RVDs) (SEQ ID NO: 4) was subcloned in the pCLS7111 using type IIs restriction enzymes BsmBI for the receiving plasmid and BbvI and SfaNI for the inserted RVD sequence, leading to pCLS7509 and subsequent TALEN (SEQ ID NO: 9).

All the mammalian target reporter plasmids containing the TALEN DNA target sequences were constructed using standard gateway Gateway protocol (INVITROGEN) into a CHO reporter vector (Grizot, Epinat et al.; Arnould, Chames et al. 2006). Activity of AvrBs3-derived TALEN was tested in our extrachromosomal assay in mammalian cells (CHO K1) as homodimer (two identical recognition sequences are placed facing each other on both DNA strands) on the target Avr15 (SEQ ID NO: 6, Table 3). For this assay, CHO K1 cells were transfected in a 96-well plate format with 75 or 200 ng of target vector and an increasing quantity of each variant DNA from 0.7 to 25 ng , in the presence of PolyFect reagent (1 μL per well). The total amount of transfected DNA was completed to 125 or 250 ng (target DNA, variant DNA, carrier DNA) using an empty vector. 72 hours after transfection, culture medium was removed and 150 μl of lysis/revelation buffer for β-galactosidase liquid assay was added. After incubation at 37° C., OD was measured at 420 nm. The entire process is performed on an automated Velocity11 BioCel platform (Grizot, Epinat et al.).

TALEN cleavage activity levels on their respective targets in mammalian cells are shown on FIG. 3.

Example 2

Engineering of the N-Terminal Domain

2.A: Rational Truncation of the N-Terminal Domain

Truncations of the first 153 (numbering based on SEQ ID NO:1)_amino acids residues of the N-terminal domain of the AvrBs3-derived TALEN (pCLS7184, SEQ ID NO: 5) were realized. DNA sequence corresponding to amino acids D154 to N228 was amplified by PCR, using the backbone plasmid pCLS7183 (referred as backbone wt, SEQ ID NO: 3) as template, to add a NcoI restriction site in 5' and a XmnI restriction site in 3'. The PCR construct was subcloned in the TALEN yeast expression backbone (pCLS7183, SEQ ID NO: 3) to replace the sequence of the N-terminal domain (referred as Nter wt) comprised between the NcoI and XmnI restriction sites, leading to pCLS7724 (SEQ ID NO: 10). All DNA sequences were validated by sequencing. The AvrBs3-derived set of repeat domains (RVDs) (SEQ ID NO: 4) was subcloned in the pCLS7724 using type IIs restriction enzymes BsmBI for the receiving plasmid and BbvI and SfaNI for the inserted RVD sequence, leading to pCLS7725 and subsequent TALEN (SEQ ID NO: 11). This truncated variant was screened in our yeast SSA assay (see Example 1) as homodimer (two identical recognition sequences are placed facing each other on both DNA strands) on the target Avr15 (SEQ ID NO: 6, Table 3). Activity level of the truncated variant is shown on FIG. 4.

2.B: Random Truncation of the N-Terminal Domain

Incremental truncation of the DNA coding for the N-terminal domain of the AvrBs3-derived TALEN (pCLS7184, SEQ ID NO: 5), starting from the 5' of the coding strand, allows the identification of minimal N-terminal domains that could still lead active TALEN. Experimentally, the complete sequence of the N-terminal domain of AvrBs3 is amplified by PCR. Restriction site BsmBI, XmnI and SacI or AatII are introduced, in this specific order at the 3' of the coding strand. After digestion with SacI or AatII, incremental truncation of the 5' is performed using a 3'5' exonuclease III. The 3' overhang created by the SacI or AatII digestion being protected from the exonuclase III digestion, unidirectional deletions are performed by controlling the digestion time and reaction conditions and an homogenous distribution of DNA fragments size (library) is obtained. Resulting DNA products (library) are blunt-ended, digested by XmnI and subcloned in a TALEN yeast expression backbone (pCLS7183, SEQ ID NO: 3) to replace the sequence of the full N-terminal domain. The AvrBs3-derived set of repeat domains (RVDs) (SEQ ID NO: 4) or any other previously synthesized RVD sequence is subcloned in the previously constructed plasmids using type IIs restriction enzymes BsmBI for the receiving plasmid. All created constructions are screened in our yeast SSA assay (see Example 1) for activity and specificity toward the AvrBs3 target or any other targets.

A particular truncated variant is judged useful if it provides, a minimal 5% retention in activity of the starting AvrBs3-derived TALEN (SEQ ID NO: 5) on its Avr15 target (SEQ ID NO: 6), more preferably a minimal 10% retention, more preferably 20%, more preferably 30%, more preferably 40%, more preferably 50%, again more preferably a retention in activity greater than 50%.

In addition, a particular variant is judged useful if it provides, on any targets having a C, G or A at position 0, a minimal 5% retention in activity of the starting AvrBs3-derived TALEN (SEQ ID NO: 5) on its Avr15 target (SEQ ID NO: 6), more preferably a minimal 10% retention, more preferably 20%, more preferably 30%, more preferably 40%, more preferably 50%, again more preferably a retention in activity greater than 50%.

2.C: Engineering of the N-Terminal Domain for Specific Recognition of the Base 0 or RVD0 of the Target Sequence and structure-based homology modelings of the C-terminal part of the N-terminal domain have pinpointed positions involved in the specific requisite of a T at position 0 of the target. Different sets of experiments are realized to overcome this limitation. In a first set of experiments, variants of the C-terminal part of the N-terminal domain are constructed to replace either the amino acids K265 and R266 by NN or SN or SNN or the amino acid R266 by N or NN. In a second set of experiments, the codons coding for these two positions are fully randomized by either two or three codons. In a third set of experiments, the complete C-terminal part of the N-terminal domain (amino acids Leu255 to Asn288) is replaced by a full RVD. All these experimental procedures are realized by using site directed mutagenesis techniques and/or combination of PCR and restriction ligation techniques well known in the art. These variants are screened for activity and specificity toward the base at position 0 (A, T, C or G) in our yeast assay (see example 1).

A particular variant is judged useful if it provides, on any or all targets, a minimal 5% retention in activity of the starting AvrBs3-derived TALEN (SEQ ID NO: 5) on its Avr15 target (SEQ ID NO: 6), more preferably a minimal 10% retention, more preferably 20%, more preferably 30%, more preferably 40%, more preferably 50%, again more preferably a retention in activity greater than 50%.

Example 3

Engineering of the C-Terminal Domain

3.A: Rational Truncation of the C-Terminal Domain

DNA sequences corresponding to truncations (numbering based on SEQ ID NO:1) after positions E886 (CO), P897 (C11), G914 (C28), L926 (C40), D950 (C64), R1000 (C115) and D1059 (C172) were amplified by PCR, using the backbone plasmid pCLS7183 (referred as backbone wt, SEQ ID NO: 3) as template, to add a XmnI restriction site in 5' and a BamHI restriction site in 3' (Protein sequences of truncated C-terminal domains C11 to C172 are respectively given in SEQ ID NO: 295 to 300). The PCR constructs were subcloned in the TALEN yeast expression backbone (pCLS7183, SEQ ID NO: 3) to replace the sequence of the full C-terminal domain, leading to pCLS7820, pCLS7802, pCLS7806, pCLS7808, pCLS7810, pCLS7812, pCLS7816 (SEQ ID NO: 12 to 18). All DNA sequences were validated by sequencing. The AvrBs3-derived set of repeat domains (RVDs) (SEQ ID NO: 4) was subcloned in pCLS7820, pCLS7802, pCLS7806, pCLS7808, pCLS7810, pCLS7812, pCLS7816 (SEQ ID NO: 12 to 18) and using type IIs restriction enzymes (BsmBI for the receiving plasmid and BbvI and SfaNI for the inserted RVD sequence) leading to pCLS7821, pCLS7803, pCLS7807, pCLS7809, pCLS7811, pCLS7813, pCLS7817 and subsequent TALENs (SEQ ID NO: 19 to 25). These truncated variants were screened in our yeast SSA assay as homodimers (two identical recognition sequences are placed facing each other on both DNA strands) on the target Avr15 (SEQ ID NO: 6, Table 3) and activity levels are shown on FIG. 5.

In addition 27 custom TALENs were tested as homodimers, in four different scaffolds (C0 truncated C-terminal domain, SEQ ID NO: 26 to 52; C11 truncated C-terminal domain, SEQ ID NO: 53 to 79; C40 truncated C-terminal domain, SEQ ID NO: 80 to 106 and full wt C-terminal domain, SEQ ID NO: 107 to 133; respective nucleic target sequences with bound nucleic acid sequences are given in table 7, SEQ ID NO: 193 to SEQ ID NO: 219). The activity of nearly all of these TALEN was increased by using truncated scaffold compared to the full C-terminal domain, also showing that respective truncation effects are not exclusive of a specific RVD sequence (Tables 6 and 7).

3.B: Lack of Specificity of the Last Terminal Half RVD

TAL effectors possess a characteristic truncated RVD (the so-called half repeat) at the end (C-terminus) of the repeat region. This half repeat is supposed to target specifically the last base of the target sequenced. To assess this specificity, an Avrbs3-derived TALEN (pCLS7184, SEQ ID NO: 5) was screened, in our yeast assay, for activity on four identical targets except for the last base (A, T, G or C, in the n position, SEQ ID NO: 171 to 174, Table 4). No significant differences in activity were observed on the four targets as shown on FIG. 7 indicating the lack of specificity of the last half RVD in this TALEN context.

3.C: Replacement of the C-Terminal Domain by a Polypeptide Linker

We generated a first library of 37 different linkers. Many of them have a common structure comprising a variable region encoding 3 to 28 amino acids residues and flanked by regions encoding SGGSGS stretch at both the 5' and a 3' end (SEQ ID NO: 134 to 170 and SEQ ID: 403 to 439). These linkers contain XmaI and BamHI restriction sites in their 5' and 3' ends respectively. The linker library is then subcloned in pCLS7183 (SEQ ID NO: 3) via the XmaI and BamHI restriction sites to replace the C-terminal domain of the AvrBs3-derived TALEN (pCLS7184, SEQ ID NO: 5). The AvrBs3-derived set of repeat domains (RVDs) or any other RVD sequences having or lacking the terminal half RVD is cloned in this backbone library plasmid as described in Example 3A and resulting clones are screened in our yeast SSA assay (see Example 1).

A particular polypeptide linker domain is judged useful if it provides a minimal 5% retention in activity of the starting AvrBs3-derived TALEN (SEQ ID NO: 5) on its Avr15 target (SEQ ID NO: 6), more preferably a minimal 10% retention, more preferably 20%, more preferably 30%, more preferably 40%, more preferably 50%, again more preferably a retention in activity greater than 50%.

The DNA (so called "polypeptide linker") coding for, seven different polypeptides (SEQ ID NO: 479 to 485) were prepared by PCR using standard molecular biology procedures. These linkers contain, at the DNA level, a XmaI and a BamHI restriction sites in their 5' and 3' ends respectively. These seven linkers were then subcloned individually into a XmaI and BamHI pre-digested backbone pCLS9943 (SEQ ID NO: 486) via the XmaI and BamHI restriction sites to create a new C-terminal domain linker scaffold (pCLS12233 to 12238 and pCLS12270, SEQ ID NO: 487 to 493). This backbone, pCLS9943, contains an additional N-terminal NLS sequence followed by an HA tag and a C11 truncated C-terminal domain compared to the original pCLS7183. The RVD arrays coding for RAGT2.3 (SEQ ID NO: 494) were subcloned individually in the pCLS12233 to pCLS12237 and pCLS12270 using type IIs restriction enzymes BsmBI for the receiving plasmid and BbvI and SfaNI for the inserted RVD sequence, leading to the seven constructs, pCLS12945 to pCLS12951 (SEQ ID NO: 495 to 501).

The resulting constructs were screened in our yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on RAGT2.3 pseudo palindromic target (SEQ ID N0214, Table 8). Activity of all seven constructs on RAGT2.3 pseudo palindromic target are summarized in FIG. 22.

Among the 37 different linkers tested, it was found that Linkers #8, #27 and #35 (SEQ ID NO: 141, 160 and 168 respectively) showed significant activity toward AvrBs3 target in our yeast assay (FIG. 26).

Example 4

Effect of the Spacer Length on Engineered TALENs

All truncated (and non-truncated) variants of the Avrbs3-derived TALENs previously described (Example 3A) were screened in the yeast assay as homodimer on targets having spacers varying in length from 5 bps to 40 bps (SEQ ID NO: 220 to 255, Table 3) in order to identify spacer lengths that enable the most efficient activity. Resulting activities of the TALENs were clearly dependent on the spacer length and on the truncation of the C-terminal domain (FIGS. 6 A to G).

Activity is detected for targets with a spacer ranging from 15 to 30 bp for the TALEN having the full C-terminal domain, activity is detected for targets with a spacer ranging from 8 to 30 bp for the TALEN having the truncation C0 or C11, activity is detected for targets with a spacer ranging from 9 bp to 30 bp for the TALEN having the truncation C28, activity is detected for targets with a spacer ranging from 11 to 30 bp for the TALEN having the truncation C40, activity is detected for targets with a spacer ranging from 12 bp to 30 bp for the TALEN having the truncation C64 and C115 and activity is detected for targets with a spacer ranging from 13 to 30 bp for the TALEN having the truncation C172.

Although a detectable activity was observed on the majority of the described targets (SEQ ID NO: 220 to 255, Table 3), an observed bias towards smaller spacer for some specific truncations (e.g. CO and C11) associated with a bias toward longer spacer for other specific truncations (e.g. C117) allows determination of the optimal C-terminal truncation of the core scaffold toward a target with specific spacer length, thus also increasing the reachable sequence space of possible targets.

Example 5

Effect of Asymmetric C-Terminal Truncations on Activity Versus Spacer Length Since heterodimeric TALEN requires such large pseudo palindromic binding sites, such sequences are unlikely to be naturally present in genomic target. Relationship between spacer length and C-terminal truncations has been studied. In such a case of heterodimeric targets, C-terminal truncations on both TALENs do not require being identical and asymmetrical truncations have been tested. All combinations of C-terminal truncated variants (prepared as described in example 3A) from the two distinct parent TALENs, respectively AvrBs3-derived (SEQ ID NO: 5) and RAGT2R (SEQ ID NO: 127) were co-transformed and tested in our yeast SSA assay (see Example 1) on 36 heterodimeric targets (SEQ ID NO: 256 to 291, Table 5).

Results show that different truncations can be associated in the same TALEN, modulating the activity over the spacer length space. Such kinds of architectures (asymmetrical) direct more precisely the cleavage on the target spacer, either on the left part or on the right part or on center part. In other words, such results allow optimizing the control of double-stranded break localization of a TALEN within its nucleic acid target sequence by associating two optimum C-terminal truncations of the core scaffold structure to an optimum spacer length wherein said association allows placing the cleavage site at a more desired location within said spacer. Said association between two optimum C-terminal truncations of the core scaffold structure and an optimum spacer length allows placing the cleavage site at a more desired location that is in the center of said spacer or not i.e either in the left part (5' located regarding the center of the spacer) of said spacer, either in the right part (3' located regarding the center of the spacer) of said spacer.

Activities of asymmetrical C-terminal truncated TALEN variants are provided in FIGS. 16 to 19. TALEN couples are combinations of AvrBs3-derived (SEQ ID NO: 5) and RAGT2R (SEQ ID NO: 127) parent TALEN containing respectively C0, C11, C40, C117 and Cter WT C-terminal domains for AvrBs3-derived constructs and C0, C11, C40 and Cter WT C-terminal domains for RAGT2R constructs.

Example 6

Activity of C-Terminal Truncated TALEN in Mammalian Cells

The DNA encoding a nuclear localization sequence NLS, either a HA tag or a S tag, the N-terminal domain, the C11 truncated C-terminal domain and a nuclease catalytic head was synthesized (TopGene Technologies) and subcloned into the pCLS1853 (SEQ ID NO: 7) mammalian expression plasmid, using AscI and XhoI restriction enzymes, leading to the backbone plasmids pCLS8425 (HA tag) and pCLS8429 (S tag) (SEQ ID NO: 175 and 176).

The C-terminal and the N-terminal domains are separated by two BsmBI restriction sites. The set of repeat domains (RVDs) binding the left part of the DNA target sequence DMDT2.1, ILRGT2.1, and HBBT1.1 (SEQ ID NO: 189, SEQ ID NO: 190 and SEQ ID NO: 192) were subcloned in the pCLS8425 using type IIs restriction enzymes BsmBI for the receiving plasmid and BbvI and SfaNI for the inserted RVD sequence, leading to pCLS8453 (DMDT2.1 left; SEQ ID NO: 180), pCLS8445 (ILRGT2.1 left; SEQ ID NO: 181), and pCLS8461 (HBBT1.1 left; SEQ ID NO: 182) and subsequent left monomer TALENs (SEQ ID NO: 180 to 182). The set of repeat domains (RVDs) binding the right part of the DNA target sequence DMDT2.1, ILRGT2.1, and HBBT1.1 (SEQ ID NO: 183 to 185) were subcloned in the pCLS8429 using type IIs restriction enzymes BsmBI for the receiving plasmids and BbvI and SfaNI for the inserted RVD sequences, leading to pCLS8457 (DMDT2.1 right; SEQ ID NO: 186), pCLS8449 (ILRGT2.1 left; SEQ ID NO: 187), and pCLS8465 (HBBT1.1 left; SEQ ID NO: 188) and subsequent TALEN (SEQ ID NO: 186 to 188).

The plasmids pair pCLS8453 and pCLS8457 were co-transformed, with its DMDT2.1 target into CHO-K1 cells in order to express the heterodimeric TALEN. Activity of the TALEN was screened in our mammalian SSA assay (see example 1).

The plasmids pair pCLS8445 and pCLS8549 were co-transformed, with its ILRGT2.1 target, into CHO-K1 cells in order to express the heterodimeric TALEN. Activity of the TALEN was screened in our mammalian SSA assay (see example 1).

The plasmids pair pCLS8461 and pCLS8465 were co-transformed, with its HBBT1.1 target, into CHO-K1 cells in order to express the heterodimeric TALEN. Activity of the TALEN was screened in our mammalian SSA assay (see example 1).

TALENs activity levels in this assay indicate that they cleave their target sequence in the CHO mammalian cells (FIG. 8).

Example 7

Activity of TALE::TevI

The catalytic domain of I-TevI (SEQ ID NO: 349), a member of the GIY-YIG endonuclease family, was fused to a TAL backbone, composed of a N-terminal domain, a central core composed of RVDs and a C-terminal domain, to create a new class of TALEN (TALE::TevI). To distinguish the orientation (N-terminal vs. C-terminal) of the catalytic domain (CD) fusions, construct names are written as either CD::TALE-RVD (catalytic domain is fused N-terminal to the TALE domain) or TALE-RVD::CD (catalytic domain is fused C-terminal to the TALE domain), where "-RVD" optionally designates the sequence recognized by the TALE domain and "CD" is the catalytic domain type. Herein we describe novel TALE::TevI constructions that target AvrBs3 sequence for example, thus named TALE-AvrBs3::TevI.

Example 7a

Activity of TALE::TevI in Yeast

A core TALE scaffold ST2 (SEQ ID NO: 464) onto which (a) different sets of RVD domains could be inserted to change DNA binding specificity, and; (b) a selection of I-TevI-derived catalytic domains could be attached, N- or C-terminal, to effect DNA cleavage (or nicking) was generated. The sT2 truncated scaffold was generated by the PCR from a full-length core TALEN scaffold template (pCLS7183, SEQ ID NO: 3) using primers CMP_G061 (SEQ ID NO: 440) and CMP_G065 (SEQ ID NO: 441) and was cloned into vector pCLS7865 (SEQ ID NO: 442) to generate pCLS7865-cTAL11_CFS1 (pCLS9009, SEQ ID NO: 443) where CFS1 designates the amino acid sequence-GSSG-(with underlying restriction site BamHI and Kpn21 in the coding DNA to facilitate cloning). Two variants of the I-TevI (SEQ ID NO: 349) catalytic domain were amplified by the PCR on templates TevCreD01 (SEQ ID NO: 109 protein in plasmid pCLS6614, SEQ ID NO: 444) using the primer pair CMP_G069 (SEQ ID NO: 445) and CMP_GO70 (SEQ ID NO: 446) or TevCreD02 (SEQ ID NO: 110 protein in plasmid pCLS6615, SEQ ID NO: 447) using the primer pair CMP_G069 (SEQ ID NO: 445) and CMP_G071 (SEQ ID NO: 448) and subcloned into the pCLS9009 backbone by restriction and ligation using BamHI and EagI restriction sites, yielding pCLS7865-cT11_TevD01 (pCLS9010, SEQ ID NO: 449) and pCLS7865-cT11_TevD02 (pCLS9011, SEQ ID NO: 450), respectively. Both fusions contains the dipeptide -GS-linking the TALE-derived DNA binding domain and I-TevI derived catalytic domain.

The DNA sequence coding for the RVDs to target the AvrBs3 site (SEQ ID NO: 4) was subcloned into both plasmids pCLS9010 (SEQ ID NO: 451) and pCLS9011 (SEQ ID NO: 452) using Type IIS restriction enzymes BsmBI for the receiving plasmid and BbvI and SfaNI for the inserted RVD sequence to create the subsequent TALE-AvrBs3::TevI constructs cT11Avr_TevD01 (pCLS9012, SEQ ID NO: 453) and cT11Avr_TevD02 (pCLS9013, SEQ ID NO: 454), respectively. These TALE-AvrBs3::TevI constructs were sequenced and the insert transferred to additional vectors as needed (see below and Example 7b).

The final TALE-AvrBs3::TevI yeast expression plasmids, pCLS8523 (SEQ ID NO: 455) and pCLS8524 (SEQ ID NO: 456), were prepared by yeast in vivo cloning using plasmids pCLS9012 and pCLS9013 (SEQ ID NO: 453 and 454), respectively. To generate an intact coding sequence by in vivo homologous recombination, approximately 40 ng of either plasmid (pCLS9012; SEQ ID NO: 453 or pCLS9013, SEQ ID NO: 454) linearized by digestion with BssHII and 1 ng of the pCLS0542 (SEQ ID NO: 2) plasmid DNA linearized by digestion with NcoI and EagI were used to transform the yeast S. cerevisiae strain FYC2-6A (MATα, trp1Δ63, leu2Δ1, his 3Δ200) using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::TevI constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBS3 targets contain two identical recognition sequences juxtaposed with the 3' ends proximal and separated by "spacer" DNA ranging from 5 to 40 bps (SEQ ID NO: 220 to 255, Table 3). TALE-AvrBs3::TevI activity levels on their respective targets in yeast cells are shown on FIG. 12. Data summarized in FIG. 12 show that TALE-AvrBs3::TevI is active against several targets in Yeast.

Example 7b

Activity of TALE::TevI in Mammalian Cells

DNA encoding the TALE-AvrBs3::TevI construct from either pCLS9012 (SEQ ID NO: 453) or pCLS9013 (SEQ ID NO: 454) was subcloned into the pCLS1853 (SEQ ID NO: 7) mammalian expression plasmid using AscI and XhoI restriction enzymes for the receiving plasmid and BssHII and XhoI restriction enzymes for the TALE-AvrBs3::TevI insert, leading to the mammalian expression plasmids pCLS8993 and pCLS8994 (SEQ ID NO: 457and 458), respectively.

All mammalian target reporter plasmids containing the TALEN DNA target sequences were constructed using the standard Gateway protocol (INVITROGEN) into a CHO reporter vector (Arnould, Chames et al. 2006, Grizot, Epinat et al. 2010). The TALE-AvrBs3::TevI constructs were tested in an extrachromosomal assay in mammalian cells (CHO K1) on pseudo palindromic targets in order to compare activity with a standard TALE-AvrBs3::FokI TALEN, which requires two binding sites for activity. AvrBS3 targets contain two identical recognition sequences juxtaposed with the 3' ends proximal and separated by "spacer" DNA ranging from 5 to 40 bps (SEQ ID NO: 220 to 255, Table 3).

For this assay, CHO K1 cells were transfected in a 96-well plate format with 75 ng of target vector and an increasing quantity of each variant DNA from 0.7 to 25 ng, in the presence of PolyFect reagent (1 μL per well). The total amount of transfected DNA was completed to 125 ng (target DNA, variant DNA, carrier DNA) using an empty vector. Seventy-two hours after transfection, culture medium was removed and 150 μl of lysis/revelation buffer for β-galactosidase liquid assay was added. After incubation at 37° C., optical density was measured at 420 nm. The entire process is performed on an automated Velocity11 BioCel platform (Grizot, Epinat et al. 2009).

Activity levels in mammalian cells for the TALE-AvrBs3::TevI constructs (12.5 ng DNA transfected) on the Avr15 target (SEQ ID NO: 230) are shown on FIG. 13. TALE-AvrBs3::TevI appears to be efficient to cleave the target sequence.

Example 7c

Engineering of the TALE::TevI

Variants differing by truncations of the C-terminal domain of the AvrBs3-derived TALEN (SEQ ID NO: 1) are chosen as starting scaffolds. A subset of these variants includes truncation after positions E886 (CO), P897 (C11), G914 (C28), L926 (C40), D950 (C64), R1000 (C115), D1059 (C172) (the protein domains of truncated C-terminal domains C11 to C172 are respectively given in SEQ ID NO: 295 to 300) and P1117 [also referred as Cter wt or WT Cter (SEQ ID NO: 400) lacking the activation domain of the C-terminal domain of natural AvrBs3 (SEQ ID NO: 1)]. The plasmids coding for the variant scaffolds containing the AvrBs3-derived N-terminal domain, the AvrBs3-derived set of repeat domains and the truncated AvrBs3-derived C-terminal domain [pCLS7821, pCLS7803, pCLS7807, pCLS7809, pCLS7811, pCLS7813, pCLS7817 (SEQ ID NO: 19 to 25) which are based on the pCLS7184 (SEQ ID NO: 5)] allow cloning of any catalytic domain in fusion to the C-terminal domain, using the restriction sites BamHI and EagI. Variants of the catalytic domain of I-TevI (SEQ ID: 349) are designed from the N-terminal region of I-TevI. A subset of these variants includes truncations of the catalytic domain, the deletion-intolerant region of its linker, the deletion-tolerant region of its linker and its zinc finger (SEQ ID: 459 to 462) (Liu, Dansereau et al. 2008). The DNA corresponding to these variants of I-TevI is amplified by the PCR to introduce, at the DNA level, a BamHI (at the 5' of the coding strand) and a EagI (at the 3' of the coding strand) restriction site and, at the protein level, a linker (for example -SGGSGS-stretch, SEQ ID NO: 463) between the C terminal domain of the TAL and the variant of the catalytic domain of I-TevI. The final TALE::TevI constructs are generated by insertion of the variant of I-TevI catalytic domains into the scaffold variants using BamHI and EagI and standard molecular biology procedures.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006). The TALE-AvrBs3::TevI constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBS3 targets contain two identical recognition sequences juxtaposed with the 3' ends proximal and separated by "spacer" DNA ranging from 5 to 40 bps (SEQ ID NO: 220 to 255, Table 3).

Example 8

Activity of TALE::NucA

NucA (SEQ ID NO: 355), a nonspecific endonuclease from Anabaena sp., was fused to a TALE-derived scaffold (composed of a N-terminal domain, a central core composed of RVDs and a C-terminal domain) to create a new class of cTALEN (TALE::NucA). To distinguish the orientation (N-terminal vs. C-terminal) of the catalytic domain (CD) fusions, construct names are written as either CD::TALE-RVD (catalytic domain is fused N-terminal to the TALE domain) or TALE-RVD::CD (catalytic domain is fused C-terminal to the TALE domain), where "-RVD" optionally designates the sequence recognized by the TALE domain and "CD" is the catalytic domain type. Herein, we describe novel TALE::NucA constructions that target for example the AvrBs3 sequence, and are thus named TALE-AvrBs3::NucA. Notably, the wild-type NucA endonuclease can be inhibited by complex formation with the NuiA protein (SEQ ID NO: 473). In a chimeric protein context, the NuiA protein can function as a protein domain to modulate the activity of NucA or TALE::NucA constructs.

Example 8a

Activity of TALE::NucA in Yeast

A core TALE scaffold, sT2 (SEQ ID NO: 464), was selected onto which (a) different sets of RVD domains could be inserted to change DNA binding specificity, and; (b) a selection of NucA-derived catalytic domains could be attached, N- or C-terminal, to effect DNA cleavage (or nicking). As previously mentioned, the sT2 truncated scaffold was generated by the PCR from a full-length core TALEN scaffold template (pCLS7183, SEQ ID NO: 3) using primers CMP_G061 (SEQ ID NO: 440) and CMP_G065 (SEQ ID NO: 441) and was cloned into vector pCLS7865 (SEQ ID NO: 442) to generate pCLS7865-cTAL11_CFS1 (pCLS9009, SEQ ID NO: 443), where CFS1 designates the amino acid sequence -GSSG-(with underlying restriction sites BamHI and Kpn2I in the coding DNA to facilitate cloning). The NucA (SEQ ID NO: 355) catalytic domain, corresponding to amino acid residues 25 to 274, was subcloned into the pCLS9009 backbone (SEQ ID NO: 443) by restriction and ligation using BamHI and EagI restriction sites, yielding pCLS7865-cT11_NucA (pCLS9937, SEQ ID NO: 465). The fusion contains the dipeptide -GS- linking the TALE-derived DNA binding domain and NucA-derived catalytic domain. The cloning step also brings at the amino acid level an AAD sequence at the Cter of the NucA catalytic domain.

The DNA sequence coding for the RVDs to target the AvrBs3 site (SEQ ID NO: 4) was subcloned into plasmid pCLS9937 (SEQ ID NO: 465) using Type IIS restriction enzymes BsmBI for the receiving plasmid and BbvI and SfaNI for the inserted RVD sequence to create the subsequent TALE-AvrBs3::NucA construct cT11Avr_NucA (pCLS9938, SEQ ID NO: 466). The TALE-AvrBs3::NucA construct was sequenced and the insert transferred to additional vectors as needed (see below).

The final TALE-AvrBs3::NucA yeast expression plasmid, pCLS9924 (SEQ ID NO: 467), was prepared by yeast in vivo cloning using plasmid pCLS9938 (SEQ ID NO: 466). To generate an intact coding sequence by in vivo homologous recombination, approximately 40 ng of plasmid (pCLS9938) linearized by digestion with BssHII and 1 ng of the pCLS0542 (SEQ ID NO: 2) plasmid DNA linearized by digestion with NcoI and EagI were used to transform the yeast *S. cerevisiae* strain FYC2-6A (MATα, trp1Δ63, leu2Δ1, his3Δ200) using a high efficienty LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::NucA construct was tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBS3 targets contain two identical recognition sequences juxtaposed with the 3' ends proximal and separated by "spacer" DNA ranging from 5 to 40 bps (SEQ ID NO: 220 to 255, Table 8). In addition, constructs were tested on a target having only a single AvrBs3 recognition site (SEQ ID NO: 468; Table 8).

Example 8b

Engineering of the TALE::NucA

Variants differing by truncations of the C-terminal domain of the AvrBs3-derived TALEN (SEQ ID NO: 5) are chosen as starting scaffolds. A subset of these variants includes truncation after positions E886 (CO), P897 (C11), G914 (C28), L926 (C40), D950 (C64), R1000 (C115), D1059 (C172) (the protein domains of truncated C-terminal domains C11 to C172 are respectively given in SEQ ID NO: 295 to 300) and P1117 [also referred as Cter wt or WT Cter (SEQ ID NO: 400) lacking the activation domain of the C-terminal domain of natural AvrBs3 (SEQ ID NO: 1)]. The plasmids coding for the variant scaffolds containing the AvrBs3-derived N-terminal domain, the AvrBs3-derived set of repeat domains and the truncated AvrBs3-derived C-terminal domain [pCLS7821, pCLS7803, pCLS7807, pCLS7809, pCLS7811, pCLS7813, pCLS7817 (SEQ ID NO: 19 to 25) which are based on the pCLS7184 (SEQ ID NO: 5)] allow cloning of any catalytic domain in fusion to the C-terminal domain, using the restriction sites BamHI and EagI.

The DNA corresponding to amino acid residues 25 to 274 of NucA is amplified by the PCR to introduce, at the DNA level, a BamHI (at the 5' of the coding strand) and a EagI (at the 3' of the coding strand) restriction site and, at the protein level, a linker (for example -SGGSGS-stretch, SEQ ID NO: 463) between the C terminal domain of the TALE and the NucA catalytic domain. The final TALE::NucA constructs are generated by insertion of the NucA catalytic domain into the scaffold variants using BamHI and EagI and standard molecular biology procedures. For example, scaffold variants truncated after positions P897 (C11), G914 (C28) and D950 (C64), respectively encoded by pCLS7803, pCLS7807, pCLS7811, (SEQ ID NO: 20, 21 and 23), were fused to the NucA catalytic domain (SEQ ID NO: 355), leading to pCLS9596, pCLS9597, and pCLS9599 (SEQ ID NO: 469 to 471). The cloning step also brings at the amino acid level an AAD sequence at the Cter of the NucA catalytic domain.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::NucA constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBs3 targets contain two identical recognition sequences juxtaposed with the 3' ends proximal and separated by "spacer" DNA ranging from 5 to 40 bps (SEQ ID NO: 220 to 255, Table 8). In addition, TALE-AvrBs3::NucA constructs were tested on a target having only a single AvrBs3 recognition site (SEQ ID NO: 468). Data summarized in FIG. 14 show that TALE-AvrBs3::NucA constructs are active on all targets having at least one AvrBs3 recognition site, according to the chimeric protein of the present invention.

Example 9

Activity of TALE::ColE7

The catalytic domain of ColE7 (SEQ ID NO: 478 of ColE7 protein SEQ ID NO: 340), a nonspecific endonuclease from *E.coli*, was fused to a TALE-derived scaffold (composed of a N-terminal domain, a central core composed of RVDs and a C-terminal domain) to create a new class of cTALEN (TALE::ColE7). To distinguish the orientation (N-terminal vs. C-terminal) of the catalytic domain (CD) fusions, construct names are written as either CD::TALE-RVD (catalytic domain is fused N-terminal to the TALE domain) or TALE-RVD::CD (catalytic domain is fused C-terminal to the TALE domain), where "-RVD" optionally designates the sequence recognized by the TALE domain and "CD" is the catalytic domain type. Herein, we describe novel TALE::ColE7 constructions that target for example the AvrBs3 sequence, and are thus named TALE-AvrBs3::ColE7. Notably, the wild-type ColE7 endonuclease can be inhibited by complex formation with the Im7 immunity protein (SEQ ID NO: 474). In a chimeric protein context, the Im7 protein can function as auxiliary protein domain to modulate the nuclease activity of ColE7 or TALE::ColE7 constructs.

Example 9a

Activity of TALE::ColE7 in Yeast

A core TALE scaffold, sT2 (SEQ ID NO: 464), was selected onto which (a) different sets of RVD domains could be inserted to change DNA binding specificity, and; (b) a selection of ColE7-derived catalytic domains could be attached, N- or C-terminal, to effect DNA cleavage (or nicking). As previously mentioned, the sT2 truncated scaffold was generated by the PCR from a full-length core TALEN scaffold template (pCLS7183, SEQ ID NO: 3) using primers CMP_G061 (SEQ ID NO: 440) and CMP_G065 (SEQ ID NO: 441) and was cloned into vector pCLS7865 (SEQ ID NO: 442) to generate pCLS7865-cTAL11_CFS1 (pCLS9009, SEQ ID NO: 443), where CFS1 designates the amino acid sequence -GSSG-(with underlying restriction sites BamHI and Kpn2I in the coding DNA to facilitate cloning). The ColE7 (SEQ ID NO: 478) catalytic domain was subcloned into the pCLS9009 backbone by restriction and ligation using Kpn2I and EagI restriction sites, yielding pCLS7865-cT11_ColE7 (pCLS9939, SEQ ID NO: 475). The fusion contains the dipeptide -GSSG-linking the TALE-derived DNA binding domain and ColE7-derived catalytic domain.

The DNA sequence coding for the RVDs to target the AvrBs3 site (SEQ ID NO: 4) was subcloned into plasmid pCLS9939 (SEQ ID NO: 475) using Type IIS restriction enzymes BsmBI for the receiving plasmid and BbvI and SfaNI for the inserted RVD sequence to create the subsequent TALE-AvrBs3::ColE7 construct cT11Avr_ColE7 (pCLS9940, SEQ ID NO: 476). The TALE-AvrBs3::ColE7 construct was sequenced and the insert transferred to additional vectors as needed (see below).

The final TALE-AvrBs3::ColE7 yeast expression plasmid, pCLS8589 (SEQ ID NO: 477), was prepared by yeast in vivo cloning using plasmid pCLS9940 (SEQ ID NO: 476). To generate an intact coding sequence by in vivo homologous recombination, approximately 40 ng of plasmid (pCLS9940) linearized by digestion with BssHII and 1 ng of the pCLS0542 (SEQ ID NO: 2) plasmid DNA linearized by digestion with NcoI and EagI were used to transform the yeast *S. cerevisiae* strain FYC2-6A (MATα, trp1Δ63, leu2Δ1, his3Δ200) using a high efficiety LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::ColE7 construct was tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBS3 targets contain two identical recognition sequences juxtaposed with the 3' ends proximal and separated by "spacer" DNA ranging from 5 to 40 bps (SEQ ID NO: 220 to 255, Table 8). In addition, constructs were tested on a target having only a single AvrBs3 recognition site (SEQ ID NO: 468, Table 8). TALE-AvrBs3::ColE7 activity levels on the respective targets in yeast cells are shown on FIG. 15.

Example 9b

Engineering of the TALE::ColE7

Variants differing by truncations of the C-terminal domain of the AvrBs3-derived TALEN (SEQ ID NO: 5) are chosen as starting scaffolds. A subset of these variants includes truncation after positions E886 (C0), P897 (C11), G914 (C28), L926 (C40), D950 (C64), R1000 (C115), D1059 (C172) (the protein domains of truncated C-terminal domains C11 to C172 are respectively given in SEQ ID NO: 295 to 300) and P1117 [also referred as Cter wt or WT Cter (SEQ ID NO: 400) lacking the activation domain of the C-terminal domain of natural AvrBs3 (SEQ ID NO: 1)]. The plasmids coding for the variant scaffolds containing the AvrBs3-derived N-terminal domain, the AvrBs3-derived set of repeat domains and the truncated AvrBs3-derived C-terminal domain [pCLS7821, pCLS7803, pCLS7807, pCLS7809, pCLS7811, pCLS7813, pCLS7817 (SEQ ID NO: 19 to 25) which are based on the pCLS7184 (SEQ ID NO: 5)] allow cloning of any catalytic domain in fusion to the C-terminal domain, using the restriction sites BamHI and EagI.

The DNA corresponding to the catalytic domain of ColE7 is amplified by the PCR to introduce, at the DNA level, a BamHI (at the 5' of the coding strand) and a EagI (at the 3' of the coding strand) restriction site and, at the protein level, a linker (for example -SGGSGS- stretch, SEQ ID NO: 463) between the C terminal domain of the TALE and the ColE7 catalytic domain.

Additionally, variants of the ColE7 endonuclease domain that modulate catalytic activity can be generated having changes (individually or combined) at the following positions: D493, R496, K497, H545, N560 and H573 [positions refer to the amino acid sequence of the entire ColE7 protein (SEQ ID NO: 340)]. The final TALE::ColE7 constructs are generated by insertion of the ColE7 catalytic domain into the scaffold variants using BamHI and EagI and standard molecular biology procedures.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-AvrBs3::ColE7 constructs are tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBS3 targets contain two identical recognition sequences juxtaposed with the 3' ends proximal and separated by "spacer" DNA ranging from 5 to 40 bps (SEQ ID NO: 220 to 255, Table 8). In addition, constructs were tested on a target having only a single AvrBs3 recognition site (SEQ ID NO: 468, Table 8).

Example 10

Engineering of the TALE-AvrBs3::EndoT7

Variants differing by truncations of the C-terminal domain of the AvrBs3-derived TALEN (SEQ ID NO: 5) are chosen as starting scaffolds. A subset of these variants includes truncation after positions E886 (C0), P897 (C11), G914 (C28), L926 (C40) and D950 (C64) (the protein domains of truncated C-terminal domains C11 to C64 are respectively given in SEQ ID NO: 295 to 298). The plasmids coding for the variant scaffolds containing the AvrBs3-derived N-terminal domain, the AvrBs3-derived set of repeat domains and the truncated AvrBs3-derived C-terminal domain [pCLS7821, pCLS7803, pCLS7807, pCLS7809, pCLS7811, (SEQ ID NO: 19 to 23) which are based on the pCLS7184 (SEQ ID NO: 5)] allow cloning of any catalytic domain in fusion to the C-terminal domain, using the restriction sites BamHI and EagI.

The DNA corresponding to amino acid residues 2-149 of EndoT7 (SEQ ID NO: 363) is amplified by the PCR to introduce, at the DNA level, a BamHI (at the 5' of the coding strand) and a EagI (at the 3' of the coding strand) restriction site and, at the protein level, a linker (for example -SGGSGS-stretch, SEQ ID NO: 463) between the C terminal domain of the TALE and the EndoT7 catalytic domain. The final TALE::EndoT7 constructs are generated by insertion of the EndoT7 catalytic domain into the scaffold variants using BamHI and EagI and standard molecular biology procedures. Scaffold variants truncated after positions E886 (C0), P897 (C11), G914 (C28), L926 (C40) and D950 (C64), respectively encoded by pCLS7821, pCLS7803, pCLS7807, pCLS7809, pCLS7811, (SEQ ID NO: 19 to 23), were fused to the EndoT7 catalytic domain (SEQ ID NO: 363), leading to pCLS9600 to pCLS9604 (SEQ ID NO: 502 to 506). The cloning step also brings at the amino acid level an AAD sequence at the Cter of the EndoT7 catalytic domain.

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006). The TALE-AvrBs3::EndoT7 constructs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBs3 targets contain two identical recognition sequences juxtaposed with the 3' ends proximal and separated by "spacer" DNA ranging from 5 to 40 bps (SEQ ID NO: 220 to 255, Table 8). Data summarized in FIG. 20 show that TALE-AvrBs3::EndoT7 constructs are active on targets having two AvrBs3 recognition site, according to the chimeric protein of the present invention.

Example 11

Replacement of the C-Terminal Domain by a Polypeptide Linker, Activity with colE7, EndoT7 and I-TevI Catalytic Heads We generated a first library of 37 different linkers. Many of them have a common structure comprising a variable region encoding 3 to 28 amino acids residues and flanked by regions encoding SGGSGS stretch at both the 5' and a 3' end (SEQ ID NO: 134 to 170 and SEQ ID: 403 to 439). These linkers contain XmaI and BamHI restriction sites in their 5' and 3' ends respectively. The linker library is then subcloned in pCLS7183 (SEQ ID NO: 3) via the XmaI and BamHI restriction sites to replace the C-terminal domain of the AvrBs3-derived TALEN (pCLS7184, SEQ ID NO: 5). The AvrBs3-derived set of repeat domains (RVDs) or any other RVD sequences having or lacking the terminal half RVD is cloned in this backbone library plasmid as described in Example 3A. DNA from the library is obtained, after scrapping of the colonies from the Petri dishes, using standard miniprep techniques. The FokI catalytic head is removed using BamHI and EagI restriction enzymes, the remaining backbone being purified using standard gel extraction techniques.

DNA coding for 3 catalytic heads presented in table 2 (SEQ ID NO: 340, 349 and 363) were amplified by the PCR to introduce, at the DNA level, a BamHI (at the 5' of the coding strand) and a EagI (at the 3' of the coding strand) restriction site and, at the protein level, a linker (for example -SGGSGS -stretch, SEQ ID NO: 463) between the C-terminal domain library and the catalytic head. After BamHI and EagI digestion and purification, the DNA coding for the different catalytic heads were individually subcloned into the library scaffold previously prepared.

DNA from the final library is obtained, after scrapping of the colonies from Petri dishes, using standard miniprep techniques and the resulting libraries are screened in our yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets in order to compare activity with a standard TALE-AvrBs3::FokI TALEN, which requires two binding sites for activity. AvrBs3 targets contain two identical recognition sequences juxtaposed with the 3' ends proximal and separated by "spacer" DNA containing 15, 18, 21 and 24 bps (SEQ ID NO: 230, 233, 236 and 239, Table 8). In addition, constructs were tested on a target having only a single AvrBs3 recognition site (SEQ ID NO: 468). Data summarized in FIGS. 21 show snumber of linkers of a fraction of constructs (linkers of SEQ ID NO: 147, 150, 156 and 162 for colE7, linkers of SEQ ID NO: 134, 153, 154, 157, 162 and 166 for I-TevI and linkers of SEQ ID NO: 134, 152, 153, 159 and 166 for EndoT7) being active on targets having one or two AvrBs3 recognition sites (FIG. 21) according to the chimeric protein of the present invention.

Example 12

Influence of TAL Repeat Number on TALEN Activity

Because the repeat number in TAL effectors ranges from 1.5 to 33.5 (refs: 2, 24), a key question is how many repeats are needed for TALEN to be active. To answer this question 52 different TALENs were constructed (SEQ ID NO: 507-558) bearing from 9.5 to 15.5 TAL repeats and their nuclease activity were tested toward homodimeric targets bearing a constant 15 bp DNA spacer (SEQ ID NO: 559-581).

Material and Methods

Tal Reports Array Assembly and Subcloning into Yeast Expression Plasmids

The 52 different TAL repeats arrays containing from 9.5 to 15.5 Tal repeats were synthesized using a solid support method consisting in a sequential assembly of TAL repeats through consecutive restriction/ligation/washing steps as shown in FIG. 23. Briefly, as an example, to assemble RAGT2.3 repeats array (SEQ ID NO: 582 encoding SEQ ID NO: 583), the first TAL repeat (SEQ ID NO: 584 encoding SEQ ID NO: 585) was immobilized on a solid support through biotin/streptavidin interaction, digested by SfaNI type 115 restriction endonuclease and then ligated to a second TAL repeat (SEQ ID NO: 586 encoding SEQ ID NO: 587) harboring SfaNI compatible overhangs at its 5' end (FIG. 23B). The resulting TAL repeats array (i.e containing TAL repeats 1 and 2) was then used as template for subsequent additions of the appropriate TAL repeats (SEQ ID NO: 588-591, encoding SEQ ID NO: 592-595 for HD, NI, respectively targeting nucleotides C, A and NN, NG respectively targeting nucleotides G and T) to generate the complete TAL repeats arrays RAGT2.3 (FIG. 23C). The complete TAL repeats array was finally digested by SfaNI to generate SfaNI overhangs at its 3' end (FIG. 23D) and then striped of the solid support using BbvI type IIS restriction endonuclease (FIG. 23E). The digested TAL repeats array was recovered and subcloned into yeast or mammalian expression plasmids harboring the Nterminal domain of AvrBs3 TAL effector and the forty first amino acids of its Cterminal domain fused to FokI type IIS restriction endonuclease (pCLS 7808, i.e. SEQ ID NO: 596 encoding SEQ ID NO: 597, FIG. 23F). pCLS7808 was derived from pCLS0542 (SEQ ID NO: 2) using NcoI and XhoI restriction sites.

Results

Figure 24:
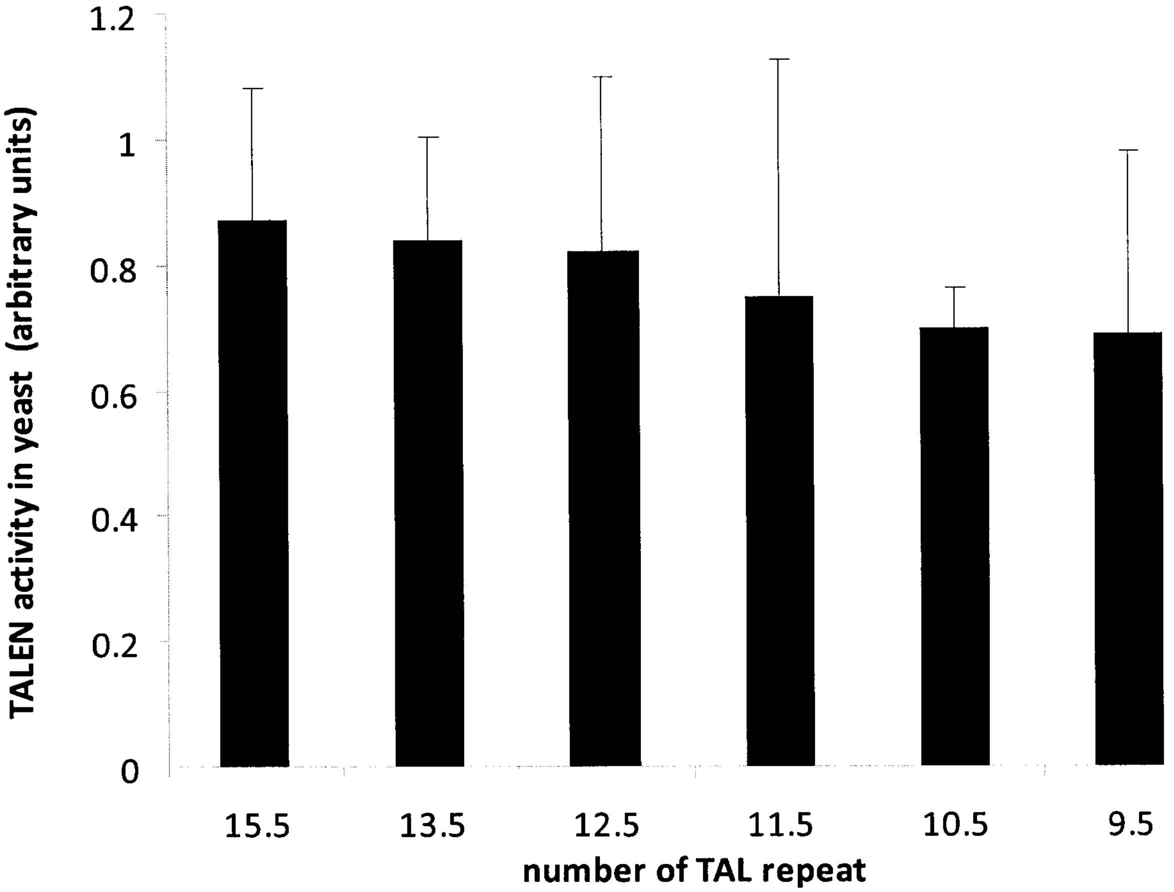

The nuclease activities of the 52 different TALENs (SEQ ID NO: 507-558) bearing from 9.5 to 15.5 TAL repeats were tested in yeast toward their homodimeric targets (SEQ ID NO: 559-581) according to the protocol described by (refs: 1, 9). Our yeast assay results showed that all the TALENs tested were active (FIG. 24).

Example 13

Influence of N and N-1 Bases Degeneracy on TALEN Activity

TAL effector DNA binding domains are known to be highly specific with respect to their cognate target (refs: 3, 25). This has been demonstrated for different TAL DNA binding domains by independent studies. However, the influence of TAL repeat number on such specificity is unclear. To address this question in a systematic manner, RAGT2.3 and RAGT2.4 TALENs were chosen as models, then the number of their TAL repeats (15.5, 13.5, 11.5 9.5 TAL repeats were iteratively reduced, according to the assembly method described in example 12 and their TALEN activity were characterized toward their respective homodimeric target degenerated in positions N and N-1 (FIG. 25, SEQ ID NO: 602-615). For the sake of clarity, FIG. 25A displays the different components of a TALEN including the N and C-terminal domains, the TAL DNA binding domain bearing the terminal half repeat and FokI catalytic domain. The FIG. 25B displays the organization of the homodimeric RAGT2.4 TALEN targets (SEQ ID NO: 601) used for our experiments including the location of thymine TO and the positions N and N-1 degenerated in this study. The FIG. 25C displays two examples of TALEN bearing 15.5 or 11.5 Tal repeats along with their respective DNA targets (top and bottom respectively, SEQ ID NO: 601).

Our results showed that the activities of RAGT2.3 and RAGT2.4 TALENs bearing 15.5 TAL repeats (SEQ ID NO: 616 and 617) were not significantly affected by single DNA/protein mismatch at N or N-1 positions (FIG. 25D). However, reduction of TAL repeats number to 13.5, 11.5 and 9.5, (SEQ ID NO: 618-620 and SEQ ID NO: 621-623) increased the sensitivity of TALEN toward DNA/protein mismatch at N or N-1 positions. Thus our results demonstrated that the TALEN sensitivity to DNA mismatch can be modulated by varying the amount of TAL repeat constituting its DNA binding domain.

Example 14

Novel Variations of the TALE::FokI Scaffold

The catalytic domain of FokI (SEQ ID NO: 600), starting at residue P381, was fused to a TALE-derived scaffold (composed of a N-terminal domain, a central core composed of RVDs and a C-terminal domain) to create a half-TALEN. To distinguish the orientation (N-terminal vs. C-terminal) of the catalytic domain (CD) fusions, construct names are written as either CD::TALE-RVD (catalytic domain is fused N-terminal to the TALE domain) or TALE-RVD::CD (catalytic domain is fused C-terminal to the TALE domain), where "-RVD" optionally designates the sequence recognized by the TALE domain and "CD" is the catalytic domain type. Herein, we describe FokI::TALE constructions that either work together with other FokI::TALE constructions in a conventional "head-to-head" configuration or can be paired with TALE::FokI constructions in a novel "tail-to-head" configuration, allowing for targeting a single DNA strand (when considering the requisite $T_0$ as 5' for target readout).

A core TALE scaffold, sT2 (SEQ ID NO: 464), was selected onto which (a) different sets of RVD domains could be inserted to change DNA binding specificity, and; (b) a selection of FokI-derived catalytic domains could be attached, N- or C-terminal, to effect DNA cleavage (or nicking). Two standard fusion scaffolds were generated: (1) pCLS7865-cTAL11_NFS1 (pCLS9008, SEQ ID NO: 624), where NFS1 designates the amino acid sequence -GSSG- (with underlying restriction sites BamHI and Kpn2I in the coding DNA to facilitate cloning), and; (2) pCLS7865-cTAL11_CFS1 (pCLS9009, SEQ ID NO: 660), where CFS1 designates the amino acid sequence -GSSG-(with underlying restriction sites BamHI and Kpn2I in the coding DNA to facilitate cloning).

Example 14a

Activity of FokI::TALE in Yeast

The catalytic domain of FokI (SEQ ID NO: 600) was subcloned by restriction and ligation into pCLS9008 (SEQ ID NO: 624) using NcoI and BamHI restriction sites, yielding the construct FokI_cT11 (SEQ ID NO: 625). The fusion contains the peptide -GSSG-linking the TALE-derived DNA binding domain and FokI derived catalytic domain.

The DNA sequence coding for the RVDs to target the AvrBS3 site (SEQ ID NO: 626) was subcloned into the FokI_cT11 (SEQ ID NO: 625) scaffold using Type 115 restriction enzymes BsmBI for the receiving plasmid and BbvI and SfaNI for the inserted RVD sequence to create the subsequent FokI::TALE-AvrBs3 construct FokI_cT11Avr (SEQ ID NO: 627). This construct was sequenced and the insert transferred to additional vectors as needed.

The final FokI::TALE-AvrBS3 yeast expression plasmid, pCLS8674 (SEQ ID NO: 628), was prepared by restriction and ligation of the FokI_cT11Avr (SEQ ID NO: 627) insert into pCLS0542 (SEQ ID NO: 2) using NcoI and EagI restriction enzymes. Plasmid pCLS8674 (SEQ ID NO: 628) was used to transform the yeast *S. cerevisiae* strain FYC2-6A (MATα, trp1Δ63, leu2Δ1, his3Δ200) using a high efficiency LiAc transformation protocol (Arnould et al. 2007).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The FokI::TALE-AvrBs3 construct was tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on pseudo palindromic targets, since the construct requires two binding sites for activity. AvrBs3 targets contain two identical recognition sequences juxtaposed with the 5' ends proximal (FIG. 9 D) and separated by "spacer" DNA ranging from 5 to 35 bps (SEQ ID NO: 629 to 659, Table 9). FokI::TALE-AvrBs3 activity levels on the respective targets in yeast cells are shown in FIG. 27.

Example 14b

Activity of the Combination TALE::FokI and FokI::TALE in Yeast

The catalytic domain of FokI (SEQ ID NO: 600) was subcloned by restriction and ligation into pCLS9009 (SEQ ID NO: 660) using Kpn2I and EagI restriction sites, yielding the construct cT11_FokI (SEQ ID NO: 6661). The fusion contains the peptide -GSSG-linking the TALE-derived DNA binding domain and FokI derived catalytic domain.

The DNA sequence coding for the RVDs to target the RagT2-R site (SEQ ID NO: 662) was subcloned into the cT11_FokI (SEQ ID NO: 661) scaffold using Type IIS restriction enzymes BsmBI for the receiving plasmid and BbvI and SfaNI for the inserted RVD sequence to create the subsequent TALE-RagT2-R::FokI construct cT11RagT2-R_FokI (SEQ ID NO: 663). This construct was sequenced and the insert transferred to additional vectors as needed.

The final TALE-RagT2-R::FokI yeast expression plasmid, pCLS9827 (SEQ ID NO: 664), was prepared by restriction and ligation of the cT11RagT2-R_FokI (SEQ ID NO: 663) insert into pCLS7763 (SEQ ID NO: 665) using NcoI and EagI restriction enzymes. The plasmid pair pCLS9827 (SEQ ID NO: 664) and pCLS8674 (SEQ ID NO: 628) was then used in co-transformation experiments in the standard yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006).

All the yeast target reporter plasmids containing the TALEN DNA target sequences were constructed as previously described (International PCT Applications WO 2004/067736 and in Epinat, Arnould et al. 2003; Chames, Epinat et al. 2005; Arnould, Chames et al. 2006; Smith, Grizot et al. 2006).

The TALE-RagT2-R::FokI/FokI::TALE-AvrBs3 construct pairs were tested in a yeast SSA assay as previously described (International PCT Applications WO 2004/067736 and in Epinat, Arnould et al. 2003; Chames, Epinat et al. 2005; Arnould, Chames et al. 2006; Smith, Grizot et al. 2006) on asymmetric RagT2-R/AvrBs3 hybrid targets and compared with a parent standard TALEN (e.g. pCLS8674 (SEQ ID NO: 628) on appropriate pseudo palindromic targets (e.g. (SEQ ID NO: 629 to 659, Table 9). RagT2-R/

AvrBs3 hybrid targets contain two different recognition sequences juxtaposed with the 3' end of the first (RagT2-R) proximal to the 5' end of the second (AvrBs3) and separated by "spacer" DNA ranging from 5 to 40 bps (SEQ ID NO: 666 to 701, Table 10). TALE-RagT2-R::FokI/FokI::TALE-AvrBs3 activity levels on the respective targets in yeast cells are shown in FIG. 28.

LIST OF CITED REFERENCES

1.Arnould, S., P. Chames, et al. (2006). "Engineering of large numbers of highly specific homing endonucleases that induce recombination on novel DNA targets." *J Mol Biol* 355(3): 443-58.
2. Boch, J. and U. Bonas (2010). "Xanthomonas AvrBs3 family-type III effectors: discovery and function." *Annu Rev Phytopathol* 48: 419-36.
3.Boch, J., H. Scholze, et al. (2009). "Breaking the code of DNA binding specificity of TAL-type III effectors." *Science* 326(5959): 1509-12.
4.Bogdanove, A. J., S. Schornack, et al. (2010). "TAL effectors: finding plant genes for disease and defense." *Curr Opin Plant Biol* 13(4): 394-401.
5. Bonas, U., R. E. Stall, et al. (1989). "Genetic and structural characterization of the avirulence gene avrBs3 from Xanthomonas campestris pv. vesicatoria." *Mol Gen Genet* 218(1): 127-36.
6. Cermak, T., E. L. Doyle, et al. (2011). "Efficient design and assembly of custom TALEN and other TAL effector-based constructs for DNA targeting." *Nucleic Acids Res.*
7. Chames, P., J. C. Epinat, et al. (2005). "In vivo selection of engineered homing endonucleases using double-strand break induced homologous recombination." *Nucleic Acids Res* 33(20): e178.
8. Christian, M., T. Cermak, et al. (2010). "Targeting DNA double-strand breaks with TAL effector nucleases." *Genetics* 186(2): 757-61.
9. Epinat, J. C., S. Arnould, et al. (2003). "A novel engineered meganuclease induces homologous recombination in yeast and mammalian cells." *Nucleic Acids Res* 31(11): 2952-62.
10. Grizot, S., J. C. Epinat, et al. "Generation of redesigned homing endonucleases comprising DNA-binding domains derived from two different scaffolds." *Nucleic Acids Res* 38(6): 2006-18.
11. Gurlebeck, D., B. Szurek, et al. (2005). "Dimerization of the bacterial effector protein AvrBs3 in the plant cell cytoplasm prior to nuclear import." *Plant J* 42(2): 175-87.
12. Li, T., S. Huang, et al. (2011). "TAL nucleases (TALNs): hybrid proteins composed of TAL effectors and FokI DNA-cleavage domain." *Nucleic Acids Res* 39(1): 359-72.
13. Li, T., S. Huang, et al. (2011). "Modularly assembled designer TAL effector nucleases for targeted gene knock-out and gene replacement in eukaryotes." *Nucleic Acids Res.*
14. Liu, Q., J. T. Dansereau, et al. (2008). "Role of the interdomain linker in distance determination for remote cleavage by homing endonuclease I-TevI." *J Mol Biol* 379(5): 1094-106.
15. Miller, J. C., S. Tan, et al. (2010). "A TALE nuclease architecture for efficient genome editing." Nat Biotechnol 29(2): 143-8.
16. Moore, I., M. Samalova, et al. (2006). "Transactivated and chemically inducible gene expression in plants." *Plant J* 45(4): 651-83.
17. Moscou, M. J. and A. J. Bogdanove (2009). "A simple cipher governs DNA recognition by TAL effectors." *Science* 326(5959): 1501.
18. Padidam, M. (2003). "Chemically regulated gene expression in plants." *Curr Opin Plant Biol* 6(2): 169-77.
19. Romer, P., S. Recht, et al. (2009). "A single plant resistance gene promoter engineered to recognize multiple TAL effectors from disparate pathogens." *Proc Natl Acad Sci U S A* 106(48): 20526-31.
20. Smith, J., S. Grizot, et al. (2006). "A combinatorial approach to create artificial homing endonucleases cleaving chosen sequences." *Nucleic Acids Res.*
21. Szurek, B., 0. Rossier, et al. (2002). "Type III-dependent translocation of the Xanthomonas AvrBs3 protein into the plant cell." *Mol Microbiol* 46(1): 13-23.
22. Wang, R., X. Zhou, et al. (2003). "Chemically regulated expression systems and their applications in transgenic plants." *Transgenic Res* 12(5): 529-40.
23. Zuo, J. and N. H. Chua (2000). "Chemical-inducible systems for regulated expression of plant genes." *Curr Opin Biotechnol* 11(2): 146-51.
24. Kay, S. & Bonas, U. How Xanthomonas type III effectors manipulate the host plant. *Curr Opin Microbiol* 12, 37-43 (2009).
25. Scholze, H. & Boch, J. TAL effector-DNA specificity. *Virulence* 1, 428-32.
26. Mak, A.N., Bradley, P., Cernadas, R.A., Bogdanove, A.J. & Stoddard, B.L. The crystal structure of TAL effector PthXo1 bound to its DNA target. *Science* 335, 716-9.

---

SEQUENCE LISTING (701 sequences)

SEQ ID NO: 1 - skipped

SEQ ID NO: 2 - DNA, 8334 bp, Artificial sequence
  synthetic polynucleotide: pCLS0542
tgtgtgcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccggcgcgcccacta

SEQ ID NO: 3 - DNA, 2217 bp, Artificial sequence
  synthetic polynucleotide: Scaffold 7183
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagccagtcagcgttgggaccgtatcctccaggcatcagggatgaaaagggccaaaccgtcccctacttcaactcaaacgccggatcaggcgtctttgcatgcattcgccgattcgctggagcgtgaccttgatgcgcctagcccaatgcacgagggagatcagacgcgggcaagtagccgtaaacggtcccgatcggatcgtgctgtcaccggtccctccgcacagcaatcgttcgaggtgcgcgttcccgaacagcgcgatgcgctccatttgcccctctcctggagggtaaaacgcccgcgtaccagtatcgggggcggcctcccggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 4 - protein, 598 aa, Artificial sequence
  synthetic polypeptide: RVD AvrBs3
LTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALE

SEQ ID NO: 5 - protein, 1321 aa, Artificial sequence
  synthetic polypeptide: pCLS7184
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 6 - DNA, 53 bp, Artificial sequence
  synthetic oligonucleotide: Avr15
tatataaacctaaccctcttagcatgaaggtaccagagggttaggtttatata

SEQ ID NO: 7 - DNA, 5672 bp, Artificial sequence
  synthetic polynucleotide: pCLS1853
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaatgaattcgactcactgttgggagacccaagctggctagttaagctatcacaagtttgtacaaaaaagcaggctggcgcgcctacacagcggccttgccaccatggccaataccaaatataacaaagagttcctgctgtacctggccggctttgtggacggtgacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccaactacatcttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgctagcacccagctttcttgtacaaagtggtgatctagagggcccgcggttcgaaggtaagcctatccctaaccctctcctcggtctcgattctacgcgtaccggttagtaatgagtttaaacgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagaccccattggggccaatacgcccgcgtttcttccttttccccaccccaccccccaagttcgggtgaaggcccagggctcgcagccaacgtcggggcggcaggccctgccatagcagatctgcgcagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 8 - DNA, 2290 bp, Artificial sequence
  synthetic polynucleotide: Scaffold 7111
ggcgcgcctacacagcggccttgccaccatgatcgattacccatacgatgttccagattacgctatcgatgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagccagtcagcgttgggaccgtatcctccaggcatcagggatgaaaagggccaaaccgtcccctacttcaactcaaacgccggatcaggcgtctttgcatgcattcgccgattcgctggagcgtgaccttgatgcgcctagcccaatgcacgagggagatcagacgcgggcaagtagccgtaaacggtcccgatcggatcgtgctgtcaccggtccctccgcacagcaatcgttcgaggtgcgcgttcccgaacagcgcgatgcgctccatttgcccctctcctggagggtaaaacgcccgcgtaccagtatcgggggcggcctcccggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgcttgataactcgag

SEQ ID NO: 9 - protein, 1334 aa, Artificial sequence
  synthetic polypeptide: pCLS7509
MIDYPYDVPDYAIDADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 10 - DNA, 1761 bp, Artificial sequence
  synthetic polynucleotide: scaffold 7724
atggccgatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagccagtcagcgttgggaccgtatcctccaggcatcagggatgaaaagggccaaaccgtcccctacttcaactcaaacgccggatcaggcgtctttgcatgcattcgccgattcgctggagcgtgaccttgatgcgcctagcccaatgcacgagggagatcagacgcgggcaagtagccgtaaacggtcccgatcggatcgtgctgtcaccggtccctccgcacagcaatcgttcgaggtgcgcgttcccgaacagcgcgatgcgctccatttgcccctctcctggagggtaaaacgcccgcgtaccagtatcgggggcggcctcccggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 11 - protein, 1169 aa, Artificial sequence
  synthetic polypeptide: pCLS7725
MADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 12 - DNA, 1536 bp, Artificial sequence
  synthetic polynucleotide: Scaffold 7820
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 13 - DNA, 1584 bp, Artificial sequence
  synthetic polynucleotide: Scaffold 7802
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgagtggcagcggaagtggcggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 14 - DNA, 1617 bp, Artificial sequence
  synthetic polynucleotide: Scaffold 7806
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 15 - DNA, 1653 bp, Artificial sequence
  synthetic polynucleotide: Scaffold 7808
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 16 - DNA, 1725 bp, Artificial sequence
  synthetic polynucleotide: Scaffold 7810
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgccgcacgcgccggccttgatcaaaagaaccaatcgccgtattcccgaacgcacatcccatcgcgttgccgacggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 17 - DNA, 1878 bp, Artificial sequence
  synthetic polynucleotide: Scaffold 7812
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcacgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 18 - DNA, 2046 bp, Artificial sequence
  synthetic polynucleotide: Scaffold 7816
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgttggccgcgttgaccaacgaccacctcgtcgccttggcctgcctcggcgggcgtcctgcgctggatgcagtgaaaaagggattgccgcacgcgccggccttgatcaaaagaaccaatcgccgtattcccgaacgcacatcccatcgcgttgccgaccacgcgcaagtggttcgcgtgctgggttttttccagtgccactcccacccagcgcaagcatttgatgacgccatgacgcagttcgggatgagcaggcacgggttgttacagctctttcgcagagtgggcgtcaccgaactcgaagcccgcagtggaacgctccccccagccagtcagcgttgggaccgtatcctccaggcatcagggatgaaaagggccaaaccgtcccctacttcaactcaaacgccggatcaggcgtctttgcatgcattcgccgattcgctggagcgtgaccttgatgcgcctagcccaatgcacgagggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 19 - protein, 1094 aa, Artificial sequence
  synthetic polypeptide: pCLS7821
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 20 - protein, 1110 aa, Artificial sequence
  synthetic polypeptide: pCLS7803
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 21 - protein, 1121 aa, Artificial sequence
  synthetic polypeptide: pCLS7807
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 22 - protein, 1133 aa, Artificial sequence
  synthetic polypeptide: pCLS7809
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 23 - protein, 1157 aa, Artificial sequence
  pCLS7811
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 24 - protein, 1208 aa, Artificial sequence
  synthetic polypeptide: pCLS7813
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARTGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 25 - protein, 1264 aa, Artificial sequence
  synthetic polypeptide: pCLS7817
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 26 - protein, 1026 aa, Artificial sequence
  synthetic polypeptide: CAPT2.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 27 - protein, 1026 aa, Artificial sequence
  synthetic polypeptide: DMDT1.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 28 - protein, 1026 aa, Artificial sequence
  synthetic polypeptide: RAGT1.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 29 - protein, 1026 aa, Artificial sequence
  synthetic polypeptide: CAPT2.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 30 - protein, 1026 aa, Artificial sequence
  synthetic polypeptide: DMDT1.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 31 - protein, 1026 aa, Artificial sequence
  synthetic polypeptide: SH6T2.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 32 - protein, 1026 aa, Artificial sequence
  synthetic polypeptide: CAPT1.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 33 - protein, 1026 aa, Artificial sequence
  synthetic polypeptide: NPTIIT5.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 34 - protein, 1026 aa, Artificial sequence
  synthetic polypeptide: ILRGT2.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 35 - protein, 1026 aa, Artificial sequence
  synthetic polypeptide: HBBT1.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 36 - protein, 1026 aa, Artificial sequence
  synthetic polypeptide: CAPT1.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 37 - protein, 1026 aa, Artificial sequence
  synthetic polypeptide: HBBT1.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 38 - protein, 1026 aa, Artificial sequence
  synthetic polypeptide: SH6T1.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 39 - protein, 1026 aa, Artificial sequence
  synthetic polypeptide: DMDT2.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 40 - protein, 1026 aa, Artificial sequence
  synthetic polypeptide: SADET3.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 41 - protein, 1026 aa, Artificial sequence
  synthetic polypeptide: NPTIIT6.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 42 - protein, 1026 aa, Artificial sequence
  synthetic polypeptide: NPTIIT.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 43 - protein, 1026 aa, Artificial sequence
  synthetic polypeptide: SH6T1.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 44 - protein, 1026 aa, Artificial sequence
  synthetic polypeptide: DMDT2.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 45 - protein, 1026 aa, Artificial sequence
  synthetic polypeptide: ILRGT2.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 46 - protein, 1026 aa, Artificial sequence
  synthetic polypeptide: RAGT2.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 47 - protein, 1026 aa, Artificial sequence
  synthetic polypeptide: RAGT2.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 48 - protein, 1026 aa, Artificial sequence
  synthetic polypeptide: NPTIIT2.3_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 49 - protein, 1026 aa, Artificial sequence
  synthetic polypeptide: RAGT1.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 50 - protein, 1026 aa, Artificial sequence
  synthetic polypeptide: NPTIIT2.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 51 - protein, 1026 aa, Artificial sequence
  synthetic polypeptide: NPTIIT6.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 52 - protein, 1026 aa, Artificial sequence
  synthetic polypeptide: SADET3.4_C0
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 53 - protein, 1042 aa, Artificial sequence
  synthetic polypeptide: CAPT2.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 54 - protein, 1042 aa, Artificial sequence
  synthetic polypeptide: DMDT1.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 55 - protein, 1042 aa, Artificial sequence
  synthetic polypeptide: RAGT1.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 56 - protein, 1042 aa, Artificial sequence
  synthetic polypeptide: CAPT2.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 57 - protein, 1042 aa, Artificial sequence
  synthetic polypeptide: DMDT1.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 58 - protein, 1042 aa, Artificial sequence
  synthetic polypeptide: SH6T2.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 59 - protein, 1042 aa, Artificial sequence
  synthetic polypeptide: CAPT1.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 60 - protein, 1042 aa, Artificial sequence
  synthetic polypeptide: NPTIIT5.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 61 - protein, 1042 aa, Artificial sequence
  synthetic polypeptide: ILRGT2.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 62 - protein, 1042 aa, Artificial sequence
  synthetic polypeptide: HBBT1.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 63 - protein, 1042 aa, Artificial sequence
  synthetic polypeptide: CAPT1.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 64 - protein, 1042 aa, Artificial sequence
  synthetic polypeptide: HBBT1.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 65 - protein, 1042 aa, Artificial sequence
  synthetic polypeptide: SH6T1.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 66 - protein, 1042 aa, Artificial sequence
  synthetic polypeptide: DMDT2.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 67 - protein, 1042 aa, Artificial sequence
  synthetic polypeptide: SADET3.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 68 - protein, 1042 aa, Artificial sequence
  synthetic polypeptide: NPTIIT6.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 69 - protein, 1042 aa, Artificial sequence
  synthetic polypeptide: NPTIIT.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 70 - protein, 1042 aa, Artificial sequence
  synthetic polypeptide: SH6T1.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 71 - protein, 1042 aa, Artificial sequence
  synthetic polypeptide: DMDT2.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 72 - protein, 1042 aa, Artificial sequence
  synthetic polypeptide: ILRGT2.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 73 - protein, 1042 aa, Artificial sequence
  synthetic polypeptide: RAGT2.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 74 - protein, 1042 aa, Artificial sequence
  synthetic polypeptide: RAGT2.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 75 - protein, 1042 aa, Artificial sequence
  synthetic polypeptide: NPTIIT2.3_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 76 - protein, 1042 aa, Artificial sequence
  synthetic polypeptide: RAGT1.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 77 - protein, 1042 aa, Artificial sequence
  synthetic polypeptide: NPTIIT2.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 78 - protein, 1042 aa, Artificial sequence
  synthetic polypeptide: NPTIIT6.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 79 - protein, 1042 aa, Artificial sequence
  synthetic polypeptide: SADET3.4_C11
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 80 - protein, 1065 aa, Artificial sequence
  synthetic polypeptide: CAPT2.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 81 - protein, 1065 aa, Artificial sequence
  synthetic polypeptide: DMDT1.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 82 - protein, 1065 aa, Artificial sequence
  synthetic polypeptide: RAGT1.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 83 - protein, 1065 aa, Artificial sequence
  synthetic polypeptide: CAPT2.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 84 - protein, 1065 aa, Artificial sequence
  synthetic polypeptide: DMDT1.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 85 - protein, 1065 aa, Artificial sequence
  synthetic polypeptide: SH6T2.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 86 - protein, 1065 aa, Artificial sequence
  synthetic polypeptide: CAPT1.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 87 - protein, 1065 aa, Artificial sequence
  synthetic polypeptide: NPTIIT5.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 88 - protein, 1065 aa, Artificial sequence
  synthetic polypeptide: ILRGT2.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 89 - protein, 1065 aa, Artificial sequence
  synthetic polypeptide: HBBT1.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 90 - protein, 1065 aa, Artificial sequence
  synthetic polypeptide: CAPT1.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 91 - protein, 1065 aa, Artificial sequence
  synthetic polypeptide: HBBT1.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 92 - protein, 1065 aa, Artificial sequence
  synthetic polypeptide: SH6T1.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 93 - protein, 1065 aa, Artificial sequence
  synthetic polypeptide: DMDT2.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 94 - protein, 1065 aa, Artificial sequence
  synthetic polypeptide: SADET3.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 95 - protein, 1065 aa, Artificial sequence
  synthetic polypeptide: NPTIIT6.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 96 - protein, 1065 aa, Artificial sequence
  synthetic polypeptide: NPTIIT.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 97 - protein, 1065 aa, Artificial sequence
  synthetic polypeptide: SH6T1.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 98 - protein, 1065 aa, Artificial sequence
  synthetic polypeptide: DMDT2.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 99 - protein, 1065 aa, Artificial sequence
  synthetic polypeptide: ILRGT2.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 100 - protein, 1065 aa, Artificial sequence
  synthetic polypeptide: RAGT2.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 101 - protein, 1065 aa, Artificial sequence
  synthetic polypeptide: RAGT2.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 102 - protein, 1065 aa, Artificial sequence
  synthetic polypeptide: NPTIIT2.3_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 103 - protein, 1065 aa, Artificial sequence
  synthetic polypeptide: RAGT1.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 104 - protein, 1065 aa, Artificial sequence
  synthetic polypeptide: NPTIIT2.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 105 - protein, 1065 aa, Artificial sequence
  synthetic polypeptide: NPTIIT6.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 106 - protein, 1065 aa, Artificial sequence
  synthetic polypeptide: SADET3.4_C40
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 107 - protein, 1253 aa, Artificial sequence
  synthetic polypeptide: CAPT2.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 108 - protein, 1253 aa, Artificial sequence
  synthetic polypeptide: DMDT1.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 109 - protein, 1253 aa, Artificial sequence
  synthetic polypeptide: RAGT1.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 110 - protein, 1253 aa, Artificial sequence
  synthetic polypeptide: CAPT2.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 111 - protein, 1253 aa, Artificial sequence
  synthetic polypeptide: DMDT1.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 112 - protein, 1253 aa, Artificial sequence
  synthetic polypeptide: SH6T2.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 113 - protein, 1253 aa, Artificial sequence
  synthetic polypeptide: CAPT1.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 114 - protein, 1253 aa, Artificial sequence
  synthetic polypeptide: NPTIIT5.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 115 - protein, 1253 aa, Artificial sequence
  synthetic polypeptide: ILRGT2.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 116 - protein, 1253 aa, Artificial sequence
  synthetic polypeptide: HBBT1.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 117 - protein, 1253 aa, Artificial sequence
  synthetic polypeptide: CAPT1.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 118 - protein, 1253 aa, Artificial sequence
  synthetic polypeptide: HBBT1.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 119 - protein, 1253 aa, Artificial sequence
  synthetic polypeptide: SH6T1.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 120 - protein, 1253 aa, Artificial sequence
  synthetic polypeptide: DMDT2.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 121 - protein, 1253 aa, Artificial sequence
  synthetic polypeptide: SADET3.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 122 - protein, 1253 aa, Artificial sequence
  synthetic polypeptide: NPTIIT6.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 123 - protein, 1253 aa, Artificial sequence
  synthetic polypeptide: NPTIIT.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 124 - protein, 1253 aa, Artificial sequence
  synthetic polypeptide: SH6T1.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 125 - protein, 1253 aa, Artificial sequence
  synthetic polypeptide: DMDT2.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 126 - protein, 1253 aa, Artificial sequence
  synthetic polypeptide: ILRGT2.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 127 - protein, 1253 aa, Artificial sequence
  synthetic polypeptide: RAGT2.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 128 - protein, 1253 aa, Artificial sequence
  synthetic polypeptide: RAGT2.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 129 - protein, 1253 aa, Artificial sequence
  synthetic polypeptide: NPTIIT2.3_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 130 - protein, 1253 aa, Artificial sequence
  synthetic polypeptide: RAGT1.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 131 - protein, 1253 aa, Artificial sequence
  synthetic polypeptide: NPTIIT2.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 132 - protein, 1253 aa, Artificial sequence
  synthetic polypeptide: NPTIIT6.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 133 - protein, 1253 aa, Artificial sequence
  synthetic polypeptide: SADET3.4_full Cter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 134 - protein, 15 aa, Artificial sequence
  synthetic polypeptide: TAL1
SGGSGSNVGSGSGSG

SEQ ID NO: 135 - protein, 20 aa, Artificial sequence
  synthetic polypeptide: TAL2
SGGSGSLTTNLTAFSGSGSG

SEQ ID NO: 136 - protein, 22 aa, Artificial sequence
  synthetic polypeptide: TAL3
SGGSGSKRRTTISIAASGSGSG

SEQ ID NO: 137 - protein, 17 aa, Artificial sequence
  synthetic polypeptide: TAL4
SGGSGSVGRQPSGSGSG

SEQ ID NO: 138 - protein, 26 aa, Artificial sequence
  synthetic polypeptide: TAL5
SGGSGSYTRLPERSELPAEISGSGSG

SEQ ID NO: 139 - protein, 38 aa, Artificial sequence
  synthetic polypeptide: TAL6
SGGSGSIVVLNRAETPLPLDPTGKVKAELDTRSGSGSG

SEQ ID NO: 140 - protein, 21 aa, Artificial sequence
  synthetic polypeptide: TAL7
SGGSGSTATPPGSVTSGSGSG

SEQ ID NO: 141 - protein, 21 aa, Artificial sequence
  synthetic polypeptide: TAL8
SGGSGSLDNFINRPVSGSGSG

SEQ ID NO: 142 - protein, 21 aa, Artificial sequence
  TAL9
SGGSGSVSSAKTTAPSGSGSG

SEQ ID NO: 143 - protein, 22 aa, Artificial sequence
  synthetic polypeptide: TAL10
SGGSGSDSKAPNASNLSGSGSG

SEQ ID NO: 144 - protein, 23 aa, Artificial sequence
  synthetic polypeptide: TAL11
SGGSGSPVKMFDRHSSLSGSGSG

SEQ ID NO: 145 - protein, 23 aa, Artificial sequence
  synthetic polypeptide: TAL12
SGGSGSAPAETKAEPMTSGSGSG

SEQ ID NO: 146 - protein, 26 aa, Artificial sequence
  synthetic polypeptide: TAL13
SGGSGSVSTDSTPVTNQKSSSGSGSG

SEQ ID NO: 147 - protein, 16 aa, Artificial sequence
  synthetic polypeptide: TAL14
SGGSGSDSVISGSGSG

SEQ ID NO: 148 - protein, 33 aa, Artificial sequence
  synthetic polypeptide: TAL15
SGGSGSARFTLAVGDNRVLDMASTYFDSGSGSG

SEQ ID NO: 149 - protein, 17 aa, Artificial sequence
  synthetic polypeptide: TAL16
SGGSGSLQENLSGSGSG

SEQ ID NO: 150 - protein, 19 aa, Artificial sequence
  synthetic polypeptide: TAL17
SGGSGSGYTYINPSGSGSG

SEQ ID NO: 151 - protein, 26 aa, Artificial sequence
  synthetic polypeptide: TAL18
SGGSGSYKLPAVTTMKVRPASGSGSG

SEQ ID NO: 152 - protein, 16 aa, Artificial sequence
  synthetic polypeptide: TAL19
SGGSGSLEGSSGSGSG

SEQ ID NO: 153 - protein, 16 aa, Artificial sequence
  synthetic polypeptide: TAL20
SGGSGSIVEASGSGSG

SEQ ID NO: 154 - protein, 18 aa, Artificial sequence
  synthetic polypeptide: TAL21
SGGSGSQTYQPASGSGSG

SEQ ID NO: 155 - protein, 27 aa, Artificial sequence
  synthetic polypeptide: TAL22
SGGSGSIARTDLKKNRDYPLASGSGSG

SEQ ID NO: 156 - protein, 18 aa, Artificial sequence
  synthetic polypeptide: TAL23
SGGSGSLPEEKGSGSGSG

SEQ ID NO: 157 - protein, 16 aa, Artificial sequence
  synthetic polypeptide: TAL24
SGGSGSYTSTSGSGSG

SEQ ID NO: 158 - protein, 20 aa, Artificial sequence
  synthetic polypeptide: TAL25
SGGSGSSRPSESEGSGSGSG

SEQ ID NO: 159 - protein, 17 aa, Artificial sequence
  synthetic polypeptide: TAL26
SGGSGSLGNSLSGSGSG

SEQ ID NO: 160 - protein, 19 aa, Artificial sequence
  synthetic polypeptide: TAL27
SGGSGSLTKYKSSSGSGSG

SEQ ID NO: 161 - protein, 33 aa, Artificial sequence
  synthetic polypeptide: TAL28
SGGSGSTEEPGAPLTTPPTLHGNQARASGSGSG

SEQ ID NO: 162 - protein, 18 aa, Artificial sequence
  synthetic polypeptide: TAL29
SGGSGSFSHSTTSGSGSG

SEQ ID NO: 163 - protein, 20 aa, Artificial sequence
  synthetic polypeptide: TAL30
SGGSGSPELKQKSSSGSGSG

SEQ ID NO: 164 - protein, 40 aa, Artificial sequence
  synthetic polypeptide: TAL31
SGGSGSILNKEKKAVSPLLLTTTNSSEGLSMGNYSGSGSG

SEQ ID NO: 165 - protein, 31 aa, Artificial sequence
  synthetic polypeptide: TAL32
ELAEFHARYADLLLRDLRERPVSLVRGPDSG

SEQ ID NO: 166 - protein, 31 aa, Artificial sequence
  synthetic polypeptide: TAL33
ELAEFHARPDPLLLRDLRERPVSLVRGLGSG

SEQ ID NO: 167 - protein, 26 aa, Artificial sequence
  synthetic polypeptide: TAL34
ELAEFHARYADLLLRDLRERSGSGSG

SEQ ID NO: 168 - protein, 31 aa, Artificial sequence
  synthetic polypeptide: TAL35
DIFDYYAGVAEVMLGHIAGRPATRKRWPNSG

SEQ ID NO: 169 - protein, 31 aa, Artificial sequence
  synthetic polypeptide: TAL36
DIFDYYAGPDPVMLGHIAGRPATRKRWLGSG

SEQ ID NO: 170 - protein, 26 aa, Artificial sequence
  synthetic polypeptide: TAL37
DIFDYYAGVAEVMLGHIAGRSGSGSG

SEQ ID NO: 171-176 - skipped (6 entries)

SEQ ID NO: 177 - protein, 530 aa, Artificial sequence
  synthetic polypeptide: RVD_DMDT2.3
LTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALE

SEQ ID NO: 178 - protein, 530 aa, Artificial sequence
  synthetic polypeptide: RVD_ILRGT2.3
LTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALE

SEQ ID NO: 179 - protein, 530 aa, Artificial sequence
  synthetic polypeptide: RVD_HBBT1.3
LTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALE

SEQ ID NO: 180 - protein, 1065 aa, Artificial sequence
  synthetic polypeptide: pCLS8453
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 181 - protein, 1065 aa, Artificial sequence
  synthetic polypeptide: pCLS8445
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 182 - protein, 1065 aa, Artificial sequence
  synthetic polypeptide: pCLS8461
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 183 - protein, 530 aa, Artificial sequence
  synthetic polypeptide: RVD_DMDT2.4
LTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALE

SEQ ID NO: 184 - protein, 530 aa, Artificial sequence
  synthetic polypeptide: RVD_ILRGT2.4
LTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALE

SEQ ID NO: 185 - protein, 530 aa, Artificial sequence
  synthetic polypeptide: RVD_HBBT1.4
LTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALE

SEQ ID NO: 186 - protein, 1071 aa, Artificial sequence
  synthetic polypeptide: pCLS8457
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 187 - protein, 1071 aa, Artificial sequence
  synthetic polypeptide: pCLS8449
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 188 - protein, 1071 aa, Artificial sequence
  synthetic polypeptide: pCLS8465
MGDPKKKRKVIDKETAAAKFERQHMDSIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALESIVAQLSRPDPSGSGSGGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAA

SEQ ID NO: 189 - DNA, 49 bp, Artificial sequence
  synthetic polynucleotide: target DMDT2.1
tgtattcctttatggatcagttaacattataaatgataactttagctca

SEQ ID NO: 190 - DNA, 49 bp, Artificial sequence
  synthetic polynucleotide: target ILRGT2.1
tgggttagcgtgttgttagagtaggggagtggattgagaaggaggctga

SEQ ID NO: 191 - skipped

SEQ ID NO: 192 - DNA, 49 bp, Artificial sequence
  synthetic polynucleotide: target HBBT1.1
tctgacacaactgtgttcactagcaacctcaaacagacaccatggtgca

SEQ ID NO: 193 - DNA, 49 bp, Artificial sequence
  synthetic polynucleotide: CAPT2.3
taaaaacaataatattttttaagtaaataaagaaatattattgttttta

SEQ ID NO: 194 - DNA, 49 bp, Artificial sequence
  synthetic polynucleotide: DMDT1.3
tttaaataacatgtcttattatctctgttaacaagacatgttatttaaa

SEQ ID NO: 195 - DNA, 49 bp, Artificial sequence
  synthetic polynucleotide: RAGT1.3
tgaataaataattgaatgtatttatttttattattcaattatttattca

SEQ ID NO: 196 - DNA, 49 bp, Artificial sequence
  synthetic polynucleotide: CAPT2.4
tggccacggcctggttttttaagtaaataaagaaaccaggccgtggcca

SEQ ID NO: 197 - DNA, 49 bp, Artificial sequence
  synthetic polynucleotide: DMDT1.4
ttaaaaagctgtacattattatctctgttaacaatgtacagctttttaa

SEQ ID NO: 198 - DNA, 49 bp, Artificial sequence
  synthetic polynucleotide: SH6T2.4
tgctgggggcaattaattttgcttcccacagcattaattgcccccagca

SEQ ID NO: 199 - DNA, 49 bp, Artificial sequence
  synthetic polynucleotide: CAPT1.4
tctgtgggctcgggtctcacagccacgatcttagacccgagcccacaga

SEQ ID NO: 200 - DNA, 55 bp, Artificial sequence
  synthetic polynucleotide: NPTIIT5.3
tccttgcgcagctgtgctcgacgttgtcactgaagcgggcacagctgcgcaagga

SEQ ID NO: 201 - DNA, 49 bp, Artificial sequence
  synthetic polynucleotide: ILRGT2.3
tgggttagcgtgttgttagagtaggggagtggaacaacacgctaaccca

SEQ ID NO: 202 - DNA, 49 bp, Artificial sequence
  synthetic polynucleotide: HBBT1.4
tgcaccatggtgtctgtcactagcaacctcaaacagacaccatggtgca

SEQ ID NO: 203 - DNA, 49 bp, Artificial sequence
  synthetic polynucleotide: CAPT1.3
tccgggaacccagagctcacagccacgatcttagctctgggttcccgga

SEQ ID NO: 204 - DNA, 49 bp, Artificial sequence
  synthetic polynucleotide: HBBT1.3
tctgacacaactgtgttcactagcaacctcaaaacacagttgtgtcaga

SEQ ID NO: 205 - DNA, 49 bp, Artificial sequence
  synthetic polynucleotide: SH6T1.4
tggtattggacagtacttaattgcccccagcaagtactgtccaatacca

SEQ ID NO: 206 - DNA, 49 bp, Artificial sequence
  synthetic polynucleotide: DMDT2.3
tgtattcctttatggatcagttaacattataaatccataaaggaataca

SEQ ID NO: 207 - DNA, 58 bp, Artificial sequence
  synthetic polynucleotide: SADET3.3
tctagattacattttctcactgtcccaatgtgcttgatatgagaaaatgtaatctaga

SEQ ID NO: 208 - DNA, 58 bp, Artificial sequence
  synthetic polynucleotide: NPTIIT6.3
tgaagcgggaagggactggctgctattgggcgaagtgccggagtcccttcccgcttca

SEQ ID NO: 209 - DNA, 55 bp, Artificial sequence
  synthetic polynucleotide: NPTIIT5.4
tagcagccagtcccttctcgacgttgtcactgaagcgggaagggactggctgcta

SEQ ID NO: 210 - DNA, 49 bp, Artificial sequence
  synthetic polynucleotide: SH6T1.3
tttgcttcccacagcattaattgcccccagcaatgctgtgggaagcaaa

SEQ ID NO: 211 - DNA, 49 bp, Artificial sequence
  synthetic polynucleotide: DMDT2.4
tgagctaaagttatcatcagttaacattataaatgataactttagctca

SEQ ID NO: 212 - DNA, 49 bp, Artificial sequence
  synthetic polynucleotide: ILRGT2.4
tcagcctccttctcaatagagtaggggagtggattgagaaggaggctga

SEQ ID NO: 213 - DNA, 49 bp, Artificial sequence
  synthetic polynucleotide: RAGT2.4
tgtttatggttacttatatgtgtgtaacaggtataagtaaccataaaca

SEQ ID NO: 214 - DNA, 49 bp, Artificial sequence
  synthetic polynucleotide: RAGT2.3
tatatttaagcacttatatgtgtgtaacaggtataagtgcttaaatata

SEQ ID NO: 215 - DNA, 49 bp, Artificial sequence
  synthetic polynucleotide: NPTIIT2.3
tgtcaagaccgacctgtccggtgccctgaatgacaggtcggtcttgaca

SEQ ID NO: 216 - DNA, 49 bp, Artificial sequence
  synthetic polynucleotide: RAGT1.4
tgatgtatcttataaatgtatttatttttattatttataagatacatca

SEQ ID NO: 217 - DNA, 49 bp, Artificial sequence
  synthetic polynucleotide: NPTIIT2.4
tgcctcgtcctgcagttccggtgccctgaatgaactgcaggacgaggca

SEQ ID NO: 218 - DNA, 58 bp, Artificial sequence
  synthetic polynucleotide: NPTIIT6.4
tgacaggagatcctgccggctgctattgggcgaagtgccggggcaggatctcctgtca

SEQ ID NO: 219 - DNA, 58 bp, Artificial sequence
  synthetic polynucleotide: SADET3.4
ttatggtggtgtcagttcactgtcccaatgtgcttgatatgaactgacaccaccataa

SEQ ID NO: 220 - DNA, 43 bp, Artificial sequence
  synthetic polynucleotide: Avr05
tatataaacctaaccctctaggtaagagggttaggtttatata

SEQ ID NO: 221 - DNA, 44 bp, Artificial sequence
  synthetic polynucleotide: Avr06
tatataaacctaaccctctaaggtaagagggttaggtttatata

SEQ ID NO: 222 - DNA, 45 bp, Artificial sequence
  synthetic polynucleotide: Avr07
tatataaacctaaccctctaaggtacagagggttaggtttatata

SEQ ID NO: 223 - DNA, 46 bp, Artificial sequence
  synthetic polynucleotide: Avr08
tatataaacctaaccctctgaaggtacagagggttaggtttatata

SEQ ID NO: 224 - DNA, 47 bp, Artificial sequence
  synthetic polynucleotide: Avr09
tatataaacctaaccctctgaaggtaccagagggttaggtttatata

SEQ ID NO: 225 - DNA, 48 bp, Artificial sequence
  synthetic polynucleotide: Avr10
tatataaacctaaccctcttgaaggtaccagagggttaggtttatata

SEQ ID NO: 226 - DNA, 49 bp, Artificial sequence
  synthetic polynucleotide: Avr11
tatataaacctaaccctcttgaaggtacctagagggttaggtttatata

SEQ ID NO: 227 - DNA, 50 bp, Artificial sequence
  synthetic polynucleotide: Avr12
tatataaacctaaccctctatgaaggtacctagagggttaggtttatata

SEQ ID NO: 228 - DNA, 51 bp, Artificial sequence
  synthetic polynucleotide: Avr13
tatataaacctaaccctctatgaaggtaccttagagggttaggtttatata

SEQ ID NO: 229 - DNA, 52 bp, Artificial sequence
  synthetic polynucleotide: Avr14
tatataaacctaaccctctcatgaaggtaccttagagggttaggtttatata

SEQ ID NO: 230 - DNA, 53 bp, Artificial sequence; identical to SEQ ID NO: 6
  synthetic polynucleotide: AVR15

SEQ ID NO: 231 - DNA, 54 bp, Artificial sequence
  synthetic polynucleotide: Avr16
tatataaacctaaccctctgcatgaaggtaccttgagagggttaggtttatata

SEQ ID NO: 232 - DNA, 55 bp, Artificial sequence
  synthetic polynucleotide: Avr17
tatataaacctaaccctctgcatgaaggtaccttgtagagggttaggtttatata

SEQ ID NO: 233 - DNA, 56 bp, Artificial sequence
  synthetic polynucleotide: Avr18
tatataaacctaaccctctagcatgaaggtaccttgtagagggttaggtttatata

SEQ ID NO: 234 - DNA, 57 bp, Artificial sequence
  synthetic polynucleotide: Avr19
tatataaacctaaccctctagcatgaaggtaccttgtcagagggttaggtttatata

SEQ ID NO: 235 - DNA, 58 bp, Artificial sequence
  synthetic polynucleotide: Avr20
tatataaacctaaccctcttagcatgaaggtaccttgtcagagggttaggtttatata

SEQ ID NO: 236 - DNA, 59 bp, Artificial sequence
  synthetic polynucleotide: Avr21
tatataaacctaaccctcttagcatgaaggtaccttgtcgagagggttaggtttatata

SEQ ID NO: 237 - DNA, 60 bp, Artificial sequence
  synthetic polynucleotide: Avr22
tatataaacctaaccctcttagcatgaaggtaccttgtcgtagagggttaggtttatata

SEQ ID NO: 238 - DNA, 61 bp, Artificial sequence
  synthetic polynucleotide: Avr23
tatataaacctaaccctctctagcatgaaggtaccttgtcgtagagggttaggtttatata

SEQ ID NO: 239 - DNA, 62 bp, Artificial sequence
  synthetic polynucleotide: Avr24
tatataaacctaaccctctctagcatgaaggtaccttgtcgttagagggttaggtttatata

SEQ ID NO: 240 - DNA, 63 bp, Artificial sequence
  synthetic polynucleotide: Avr25
tatataaacctaaccctctactagcatgaaggtaccttgtcgttagagggttaggtttatata

SEQ ID NO: 241 - DNA, 64 bp, Artificial sequence
  synthetic polynucleotide: Avr26
tatataaacctaaccctctactagcatgaaggtaccttgtcgttgagagggttaggtttatata

SEQ ID NO: 242 - DNA, 65 bp, Artificial sequence
  synthetic polynucleotide: Avr27
tatataaacctaaccctctcactagcatgaaggtaccttgtcgttgagagggttaggtttatata

SEQ ID NO: 243 - DNA, 66 bp, Artificial sequence
  synthetic polynucleotide: Avr28
tatataaacctaaccctctcactagcatgaaggtaccttgtcgttgaagagggttaggtttatata

SEQ ID NO: 244 - DNA, 67 bp, Artificial sequence
  synthetic polynucleotide: Avr29
tatataaacctaaccctctccactagcatgaaggtaccttgtcgttgaagagggttaggtttatata

SEQ ID NO: 245 - DNA, 68 bp, Artificial sequence
  synthetic polynucleotide: Avr30
tatataaacctaaccctctccactagcatgaaggtaccttgtcgttgatagagggttaggtttatata

SEQ ID NO: 246 - DNA, 69 bp, Artificial sequence
  synthetic polynucleotide: Avr31
tatataaacctaaccctctaccactagcatgaaggtaccttgtcgttgatagagggttaggtttatata

SEQ ID NO: 247 - DNA, 70 bp, Artificial sequence
  synthetic polynucleotide: Avr32
tatataaacctaaccctctaccactagcatgaaggtaccttgtcgttgattagagggttaggtttatata

SEQ ID NO: 248 - DNA, 71 bp, Artificial sequence
  synthetic polynucleotide: Avr33
tatataaacctaaccctctgaccactagcatgaaggtaccttgtcgttgattagagggttaggtttatata

SEQ ID NO: 249 - DNA, 72 bp, Artificial sequence
  synthetic polynucleotide: Avr34
tatataaacctaaccctctgaccactagcatgaaggtaccttgtcgttgattcagagggttaggtttatata

SEQ ID NO: 250 - DNA, 73 bp, Artificial sequence
  synthetic polynucleotide: Avr35
tatataaacctaaccctcttgaccactagcatgaaggtaccttgtcgttgattcagagggttaggtttatata

SEQ ID NO: 251 - DNA, 74 bp, Artificial sequence
  synthetic polynucleotide: Avr36
tatataaacctaaccctcttgaccactagcatgaaggtaccttgtcgttgattcaagagggttaggtttatata

SEQ ID NO: 252 - DNA, 75 bp, Artificial sequence
  synthetic polynucleotide: Avr37
tatataaacctaaccctctctgaccactagcatgaaggtaccttgtcgttgattcaagagggttaggtttatata

SEQ ID NO: 253 - DNA, 76 bp, Artificial sequence
  synthetic polynucleotide: Avr38
tatataaacctaaccctctctgaccactagcatgaaggtaccttgtcgttgattcagagagggttaggtttatata

SEQ ID NO: 254 - DNA, 77 bp, Artificial sequence
  synthetic polynucleotide: Avr39
tatataaacctaaccctcttctgaccactagcatgaaggtaccttgtcgttgattcagagagggttaggtttatata

SEQ ID NO: 255 - DNA, 78 bp, Artificial sequence
  synthetic polynucleotide: Avr40
tatataaacctaaccctcttctgaccactagcatgaaggtaccttgtcgttgattcagtagagggttaggtttatata

SEQ ID NO: 256 - DNA, 76 bp, Artificial sequence
  synthetic polynucleotide: Avr40RAGT2R
tatataaacctaaccctcttctgaccactagcatgaaggtaccttgtcgttgattcagtataagtaaccataaaca

SEQ ID NO: 257 - DNA, 75 bp, Artificial sequence
  synthetic polynucleotide: Avr39RAGT2R
tatataaacctaaccctcttctgaccactagcatgaaggtaccttgtcgttgattcagataagtaaccataaaca

SEQ ID NO: 258 - DNA, 74 bp, Artificial sequence
  synthetic polynucleotide: Avr38RAGT2R
tatataaacctaaccctctctgaccactagcatgaaggtaccttgtcgttgattcagataagtaaccataaaca

SEQ ID NO: 259 - DNA, 73 bp, Artificial sequence
  synthetic polynucleotide: Avr37RAGT2R
tatataaacctaaccctctctgaccactagcatgaaggtaccttgtcgttgattcaataagtaaccataaaca

SEQ ID NO: 260 - DNA, 72 bp, Artificial sequence
  synthetic polynucleotide: Avr36RAGT2R
tatataaacctaaccctcttgaccactagcatgaaggtaccttgtcgttgattcaataagtaaccataaaca

SEQ ID NO: 261 - DNA, 71 bp, Artificial sequence
  synthetic polynucleotide: Avr35RAGT2R
tatataaacctaaccctcttgaccactagcatgaaggtaccttgtcgttgattcataagtaaccataaaca

SEQ ID NO: 262 - DNA, 70 bp, Artificial sequence
  synthetic polynucleotide: Avr34RAGT2R
tatataaacctaaccctctgaccactagcatgaaggtaccttgtcgttgattcataagtaaccataaaca

SEQ ID NO: 263 - DNA, 69 bp, Artificial sequence
  synthetic polynucleotide: Avr33RAGT2R
tatataaacctaaccctctgaccactagcatgaaggtaccttgtcgttgattataagtaaccataaaca

SEQ ID NO: 264 - DNA, 68 bp, Artificial sequence
  synthetic polynucleotide: Avr32RAGT2R
tatataaacctaaccctctaccactagcatgaaggtaccttgtcgttgattataagtaaccataaaca

SEQ ID NO: 265 - DNA, 67 bp, Artificial sequence
  synthetic polynucleotide: Avr31RAGT2R
tatataaacctaaccctctaccactagcatgaaggtaccttgtcgttgatataagtaaccataaaca

SEQ ID NO: 266 - DNA, 66 bp, Artificial sequence
  synthetic polynucleotide: Avr30RAGT2R
tatataaacctaaccctctccactagcatgaaggtaccttgtcgttgatataagtaaccataaaca

SEQ ID NO: 267 - DNA, 65 bp, Artificial sequence
  synthetic polynucleotide: AVR29RAGT2R
tatataaacctaaccctctccactagcatgaaggtaccttgtcgttgaataagtaaccataaaca

SEQ ID NO: 268 - DNA, 64 bp, Artificial sequence
  synthetic polynucleotide: Avr28RAGT2R
tatataaacctaaccctctcactagcatgaaggtaccttgtcgttgaataagtaaccataaaca

SEQ ID NO: 269 - DNA, 63 bp, Artificial sequence
  synthetic polynucleotide: Avr27RAGT2R
tatataaacctaaccctctcactagcatgaaggtaccttgtcgttgataagtaaccataaaca

SEQ ID NO: 270 - DNA, 62 bp, Artificial sequence
  synthetic polynucleotide: Avr26RAGT2R
tatataaacctaaccctctactagcatgaaggtaccttgtcgttgataagtaaccataaaca

SEQ ID NO: 271 - DNA, 61 bp, Artificial sequence
  synthetic polynucleotide: Avr25RAGT2R
tatataaacctaaccctctactagcatgaaggtaccttgtcgttataagtaaccataaaca

SEQ ID NO: 272 - DNA, 60 bp, Artificial sequence
  synthetic polynucleotide: Avr24RAGT2R
tatataaacctaaccctctctagcatgaaggtaccttgtcgttataagtaaccataaaca

SEQ ID NO: 273 - DNA, 59 bp, Artificial sequence
  synthetic polynucleotide: Avr23RAGT2R
tatataaacctaaccctctctagcatgaaggtaccttgtcgtataagtaaccataaaca

SEQ ID NO: 274 - DNA, 58 bp, Artificial sequence
  synthetic polynucleotide: Avr22RAGT2R
tatataaacctaaccctcttagcatgaaggtaccttgtcgtataagtaaccataaaca

SEQ ID NO: 275 - DNA, 57 bp, Artificial sequence
  synthetic polynucleotide: Avr21RAGT2R
tatataaacctaaccctcttagcatgaaggtaccttgtcgataagtaaccataaaca

SEQ ID NO: 276 - DNA, 56 bp, Artificial sequence
  synthetic polynucleotide: Avr20RAGT2R
tatataaacctaaccctcttagcatgaaggtaccttgtcataagtaaccataaaca

SEQ ID NO: 277 - DNA, 55 bp, Artificial sequence
  synthetic polynucleotide: Avr19RAGT2R
tatataaacctaaccctctagcatgaaggtaccttgtcataagtaaccataaaca

SEQ ID NO: 278 - DNA, 54 bp, Artificial sequence
  synthetic polynucleotide: Avr18RAGT2R
tatataaacctaaccctctagcatgaaggtaccttgtataagtaaccataaaca

SEQ ID NO: 279 - DNA, 53 bp, Artificial sequence
  synthetic polynucleotide: Avr17RAGT2R
tatataaacctaaccctctgcatgaaggtaccttgtataagtaaccataaaca

SEQ ID NO: 280 - DNA, 52 bp, Artificial sequence
  synthetic polynucleotide: Avr16RAGT2R
tatataaacctaaccctctgcatgaaggtaccttgataagtaaccataaaca

SEQ ID NO: 281 - DNA, 51 bp, Artificial sequence
  synthetic polynucleotide: Avr15RAGT2R
tatataaacctaaccctcttagcatgaaggtaccataagtaaccataaaca

SEQ ID NO: 282 - DNA, 50 bp, Artificial sequence
  synthetic polynucleotide: Avr14RAGT2R
tatataaacctaaccctctcatgaaggtaccttataagtaaccataaaca

SEQ ID NO: 283 - DNA, 49 bp, Artificial sequence
  synthetic polynucleotide: Avr13RAGT2R
tatataaacctaaccctctatgaaggtaccttataagtaaccataaaca

SEQ ID NO: 284 - DNA, 48 bp, Artificial sequence
  synthetic polynucleotide: Avr12RAGT2R
tatataaacctaaccctctatgaaggtacctataagtaaccataaaca

SEQ ID NO: 285 - DNA, 47 bp, Artificial sequence
  synthetic polynucleotide: Avr11RAGT2R
tatataaacctaaccctcttgaaggtacctataagtaaccataaaca

SEQ ID NO: 286 - DNA, 46 bp, Artificial sequence
  synthetic polynucleotide: Avr10RAGT2R
tatataaacctaaccctcttgaaggtaccataagtaaccataaaca

SEQ ID NO: 287 - DNA, 45 bp, Artificial sequence
  synthetic polynucleotide: Avr09RAGT2R
tatataaacctaaccctctgaaggtaccataagtaaccataaaca

SEQ ID NO: 288 - DNA, 44 bp, Artificial sequence
  synthetic polynucleotide: Avr08RAGT2R
tatataaacctaaccctctgaaggtacataagtaaccataaaca

SEQ ID NO: 289 - DNA, 43 bp, Artificial sequence
  synthetic polynucleotide: Avr07RAGT2R
tatataaacctaaccctctaaggtacataagtaaccataaaca

SEQ ID NO: 290 - DNA, 42 bp, Artificial sequence
  synthetic polynucleotide: Avr06RAGT2R
tatataaacctaaccctctaaggtaataagtaaccataaaca

SEQ ID NO: 291 - DNA, 41 bp, Artificial sequence
  synthetic polynucleotide: Avr05RAGT2R
tatataaacctaaccctctaggtaataagtaaccataaaca

SEQ ID NO: 292 - protein, 289 aa, Artificial sequence
  synthetic polypeptide: Full Nter
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 293 - protein, 137 aa, Artificial sequence
  synthetic polypeptide: Delta152 Nter
MADLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLN

SEQ ID NO: 294 - skipped

SEQ ID NO: 295 - protein, 11 aa, Artificial sequence
  synthetic polypeptide: C11 Cter
SIVAQLSRPDP

SEQ ID NO: 296 - protein, 29 aa, Artificial sequence
  synthetic polypeptide: C28 Cter
SIVAQLSRPDPALAALTNDHLVALACLGG

SEQ ID NO: 297 - protein, 40 aa, Artificial sequence
  synthetic polypeptide: C40 Cter
SIVAQLSRPDPALAALTNDHLVALACLGGRPALDAVKKGL

SEQ ID NO: 298 - protein, 64 aa, Artificial sequence
  synthetic polypeptide: C64 Cter
SIVAQLSRPDPALAALTNDHLVALACLGGRPALDAVKKGLPHAPALIKRTNRRIPERTSHRVAD

SEQ ID NO: 299 - protein, 114 aa, Artificial sequence
  synthetic polypeptide: C115 Cter
SIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEAR

SEQ ID NO: 300 - protein, 173 aa, Artificial sequence
  synthetic polypeptide: C172 Cter
SIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGD

SEQ ID NO: 301 - protein, 3 aa, Artificial sequence
  synthetic polypeptide: 1a8h_1
NVG

SEQ ID NO: 302 - protein, 4 aa, Artificial sequence
  synthetic polypeptide: 1dnpA_1
DSVI

SEQ ID NO: 303 - protein, 4 aa, Artificial sequence
  synthetic polypeptide: 1d8cA_2
IVEA

SEQ ID NO: 304 - protein, 4 aa, Artificial sequence
  synthetic polypeptide: 1ckqA_3
LEGS

SEQ ID NO: 305 - protein, 4 aa, Artificial sequence
  synthetic polypeptide: 1sbp_1
YTST

SEQ ID NO: 306 - protein, 5 aa, Artificial sequence
  synthetic polypeptide: 1ev7A_1
LQENL

SEQ ID NO: 307 - protein, 5 aa, Artificial sequence
  synthetic polypeptide: 1alo_3
VGRQP

SEQ ID NO: 308 - protein, 5 aa, Artificial sequence
  synthetic polypeptide: 1amf_1
LGNSL

SEQ ID NO: 309 - protein, 6 aa, Artificial sequence
  synthetic polypeptide: 1adjA_3
LPEEKG

SEQ ID NO: 310 - protein, 6 aa, Artificial sequence
  synthetic polypeptide: 1fcdC_1
QTYQPA

SEQ ID NO: 311 - protein, 6 aa, Artificial sequence
  synthetic polypeptide: 1al3_2
FSHSTT

SEQ ID NO: 312 - protein, 7 aa, Artificial sequence
  synthetic polypeptide: 1g3p_1
GYTYINP

SEQ ID NO: 313 - protein, 7 aa, Artificial sequence
  synthetic polypeptide: 1acc_3
LTKYKSS

SEQ ID NO: 314 - protein, 8 aa, Artificial sequence
  synthetic polypeptide: 1ahjB_1
SRPSESEG

SEQ ID NO: 315 - protein, 8 aa, Artificial sequence
  synthetic polypeptide: 1acc_1
PELKQKSS

SEQ ID NO: 316 - protein, 8 aa, Artificial sequence
  synthetic polypeptide: 1af7_1
LTTNLTAF

SEQ ID NO: 317 - protein, 9 aa, Artificial sequence
  synthetic polypeptide: 1heiA_1
TATPPGSVT

SEQ ID NO: 318 - protein, 9 aa, Artificial sequence
  synthetic polypeptide: 1bia_2
LDNFINRPV

SEQ ID NO: 319 - protein, 9 aa, Artificial sequence
  synthetic polypeptide: 1igtB_1
VSSAKTTAP

SEQ ID NO: 320 - protein, 10 aa, Artificial sequence
  synthetic polypeptide: 1nfkA_1
DSKAPNASNL

SEQ ID NO: 321 - protein, 10 aa, Artificial sequence
  synthetic polypeptide: 1au7A_1
KRRTTISIAA

SEQ ID NO: 322 - protein, 11 aa, Artificial sequence
  synthetic polypeptide: 1bpoB_1
PVKMFDRHSSL

SEQ ID NO: 323 - protein, 11 aa, Artificial sequence
  synthetic polypeptide: 1b0pA_2
APAETKAEPMT

SEQ ID NO: 324 - protein, 14 aa, Artificial sequence
  synthetic polypeptide: 1c05A_2
YTRLPERSELPAEI

SEQ ID NO: 325 - protein, 14 aa, Artificial sequence
  synthetic polypeptide: 1gcb_1
VSTDSTPVTNQKSS

SEQ ID NO: 326 - protein, 14 aa, Artificial sequence
  synthetic polypeptide: 1bt3A_1
YKLPAVTTMKVRPA

SEQ ID NO: 327 - protein, 15 aa, Artificial sequence
  synthetic polypeptide: 1b3oB_2
IARTDLKKNRDYPLA

SEQ ID NO: 328 - protein, 21 aa, Artificial sequence
  synthetic polypeptide: 16vpA_6
TEEPGAPLTTPPTLHGNQARA

SEQ ID NO: 329 - protein, 21 aa, Artificial sequence
  synthetic polypeptide: 1dhx_1
ARFTLAVGDNRVLDMASTYFD

SEQ ID NO: 330 - protein, 26 aa, Artificial sequence
  synthetic polypeptide: 1b8aA_1
IVVLNRAETPLPLDPTGKVKAELDTR

SEQ ID NO: 331 - protein, 28 aa, Artificial sequence
  synthetic polypeptide: 1qu6A_1
ILNKEKKAVSPLLLTTTNSSEGLSMGNY

SEQ ID NO: 332 - protein, 20 aa, Artificial sequence
  synthetic polypeptide: NFS1
GSDITKSKISEKMKGQGPSG

SEQ ID NO: 333 - protein, 23 aa, Artificial sequence
  synthetic polypeptide: NFS2
GSDITKSKISEKMKGLGPDGRKA

SEQ ID NO: 334 - protein, 10 aa, Artificial sequence
  synthetic polypeptide: CFS1
SLTKSKISGS

SEQ ID NO: 335 - protein, 32 aa, Artificial sequence
  synthetic polypeptide: RM2
AAGGSALTAGALSLTAGALSLTAGALSGGGGS

SEQ ID NO: 336 - protein, 27 aa, Artificial sequence
  synthetic polypeptide: BQY
AAGASSVSASGHIAPLSLPSSPPSVGS

SEQ ID NO: 337 - protein, 5 aa, Artificial sequence
  synthetic polypeptide: QGPSG
QGPSG

SEQ ID NO: 338 - protein, 8 aa, Artificial sequence
  synthetic polypeptide: LGPDGRKA
LGPDGRKA

SEQ ID NO: 339 - protein, 919 aa, Methylophilus methylotrophus
  MISC_FEATURE (1)..(919): MmeI ACC85607.1
MALSWNEIRRKAIEFSKRWEDASDENSQAKPFLIDFFEVFGITNKRVATFEHAVKKFAKAHKEQSRGFVDLFWPGILLIEMKSRGKDLDKAYDQALDYFSGIAERDLPRYVLVCDFQRFRLTDLITKESVEFLLKDLYQNVRSFGFIAGYQTQVIKPQDPINIKAAERMGKLHDTLKLVGYEGHALELYLVRLLFCLFAEDTTIFEKSLFQEYIETKTLEDGSDLAHHINTLFYVLNTPEQKRLKNLDEHLAAFPYINGKLFEEPLPPAQFDKAMREALLDLCSLDWSRISPAIFGSLFQSIMDAKKRRNLGAHYTSEANILKLIKPLFLDELWVEFEKVKNNKNKLLAFHKKLRGLTFFDPACGCGNFLVITYRELRLLEIEVLRGLHRGGQQVLDIEHLIQINVDQFFGIEIEEFPAQIAQVALWLTDHQMNMKISDEFGNYFARIPLKSTPHILNANALQIDWNDVLEAKKCCFILGNPPFVGKSKQTPGQKADLLSVFGNLKSASDLDLVAAWYPKAAHYIQTNANIRCAFVSTNSITQGEQVSLLWPLLLSLGIKINFAHRTFSWTNEASGVAAVHCVIIGFGLKDSDEKIIYEYESINGEPLAIKAKNINPYLRDGVDVIACKRQQPISKLPSMRYGNKPTDDGNFLFTDEEKNQFITNEPSSEKYFRRFVGGDEFINNTSRWCLWLDGADISEIRAMPLVLARIKKVQEFRLKSSAKPTRQSASTPMKFFYISQPDTDYLLIPETSSENRQFIPIGFVDRNVISSNATYHIPSAEPLIFGLLSSTMHNCWMRNVGGRLESRYRYSASLVYNTFPWIQPNEKQSKAIEEAAFAILKARSNYPNESLAGLYDPKTMPSELLKAHQKLDKAVDSVYGFKGPNTEIARIAFLFETYQKMTSLLPPEKEIKKSKGKN

SEQ ID NO: 340 - protein, 576 aa, Escherichia coli
  MISC_FEATURE (1)..(576): Colicin-E7 (CEA7_ECOLX) Q47112.2
MSGGDGRGHNSGAHNTGGNINGGPTGLGGNGGASDGSGWSSENNPWGGGSGSGVHWGGGSGHGNGGGNSNSGGGSNSSVAAPMAFGFPALAAPGAGTLGISVSGEALSAAIADIFAALKGPFKFSAWGIALYGILPSEIAKDDPNMMSKIVTSLPAETVTNVQVSTLPLDQATVSVTKRVTDVVKDTRQHIAVVAGVPMSVPVVNAKPTRTPGVFHASFPGVPSLTVSTVKGLPVSTTLPRGITEDKGRTAVPAGFTFGGGSHEAVIRFPKESGQKPVYVSVTDVLTPAQVKQRQDEEKRLQQEWNDAHPVEVAERNYEQARAELNQANKDVARNQERQAKAVQVYNSRKSELDAANKTLADAKAEIKQFERFAREPMAAGHRMWQMAGLKAQRAQTDVNNKKAAFDAAAKEKSDADVALSSALERRKQKENKEKDAKAKLDKESKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGK

SEQ ID NO: 341 - protein, 274 aa, Streptococcus pneumoniae [sequence omitted]

SEQ ID NO: 342 - protein, 235 aa, Escherichia coli
  MISC_FEATURE (1)..(235): Endo I (END1_ECOLI) P25736.1
MYRYLSIAAVVLSAAFSGPALAEGINSFSQAKAAAVKVHADAPGTFYCGCKINWQGKKGVVDLQSCGYQVRKNENRASRVEWEHVVPAWQFGHQRQCWQDGGRKNCAKDPVYRKMESDMHNLQPSVGEVNGDRGNFMYSQWNGGEGQYGQCAMKVDFKEKAAEPPARARGAIARTYFYMRDQYNLTLSRQQTQLFNAWNKMYPVTDWECERDERIAKVQGNHNPYVQRACQARKS

SEQ ID NO: 343 - protein, 297 aa, Homo sapiens
  MISC_FEATURE (1)..(297): Human Endo G (NUCG_HUMAN) Q14249.4
MRALRAGLTLASGAGLGAVVEGWRRRREDARAAPGLLGRLPVLPVAAAAELPPVPGGPRGPGELAKYGLPGLAQLKSRESYVLCYDPRTRGALWVVEQLRPERLRGDGDRRECDFREDDSVHAYHRATNADYRGSGFDRGHLAAAANHRWSQKAMDDTFYLSNVAPQVPHLNQNAWNNLEKYSRSLTRSYQNVYVCTGPLFLPRTEADGKSYVKYQVIGKNHVAVPTHFFKVLILEAAGGQIELRTYVMPNAPVDEAIPLERFLVPIESIERASGLLFVPNILARAGSLKAITAGSK

SEQ ID NO: 344 - protein, 299 aa, Bos taurus
  MISC_FEATURE (1)..(299): Bovine Endo G (NUCG_BOVIN) P38447.1
MQLLRAGLTLALGAGLGAAAESWWRQRADARATPGLLSRLPVLPVAAAAGLPAVPGAPAGGGPGELAKYGLPGVAQLKSRASYVLCYDPRTRGALWVVEQLRPEGLRGDGNRSSCDFHEDDSVHAYHRATNADYRGSGFDRGHLAAAANHRWSQKAMDDTFYLSNVAPQVPHLNQNAWNNLEKYSRSLTRTYQNVYVCTGPLFLPRTEADGKSYVKYQVIGKNHVAVPTHFFKVLILEAAGGQIELRSYVMPNAPVDEAIPLEHFLVPIESIERASGLLFVPNILARAGSLKAITAGSK

SEQ ID NO: 345 - protein, 247 aa, Haemophilus influenzae
  MISC_FEATURE (1)..(247): R.HinP1I AAW33811.1
MNLVELGSKTAKDGFKNEKDIADRFENWKENSEAQDWLVTMGHNLDEIKSVKAVVLSGYKSDINVQVLVFYKDALDIHNIQVKLVSNKRGFNQIDKHWLAHYQEMWKFDDNLLRILRHFTGELPPYHSNTKDKRRMFMTEFSQEEQNIVLNWLEKNRVLVLTDILRGRGDFAAEWVLVAQKVSNNARWILRNINEVLQHYGSGDISLSPRGSINFGRVTIQRKGGDNGRETANMLQFKIDPTELFDI

SEQ ID NO: 346 - protein, 188 aa, Bacillus phage Bastille
  MISC_FEATURE (1)..(188): I-BasI AAO93095.1
MFQEEWKDVTGFEDYYEVSNKGRVASKRTGVIMAQYKINSGYLCIKFTVNKKRTSHLVHRLVAREFCEGYSPELDVNHKDTDRMNNNYDNLEWLTRADNLKDVRERGKLNTHTAREALAKVSKKAVDVYTKDGSEYIATYPSATEAAEALGVQGAKISTVCHGKRQHTGGYHFKFNSSVDPNRSVSKK

SEQ ID NO: 347 - protein, 266 aa, Bacillus mojavensis
  MISC_FEATURE (1)..(266): I-BmoI AAK09365.1
MKSGVYKITNKNTGKFYIGSSEDCESRLKVHFRNLKNNRHINRYLNNSFNKHGEQVFIGEVIHILPIEEAIAKEQWYIDNFYEEMYNISKSAYHGGDLTSYHPDKRNIILKRADSLKKVYLKMTSEEKAKRWQCVQGENNPMFGRKHTETTKLKISNHNKLYYSTHKNPFKGKKHSEESKTKLSEYASQRVGEKNPFYGKTHSDEFKTYMSKKFKGRKPKNSRPVIIDGTEYESATEASRQLNVVPATILHRIKSKNEKYSGYFYK

SEQ ID NO: 348 - protein, 174 aa, Bacillus phage SPO1
  MISC_FEATURE (1)..(174): I-HmuI P34081.1
MEWKDIKGYEGHYQVSNTGEVYSIKSGKTLKHQIPKDGYHRIGLFKGGKGKTFQVHRLVAIHFCEGYEEGLVVDHKDGNKDNNLSTNLRWVTQKINVENQMSRGTLNVSKAQQIAKIKNQKPIIVISPDGIEKEYPSTKCACEELGLTRGKVTDVLKGHRIHHKGYTFRYKLNG

SEQ ID NO: 349 - protein, 245 aa, Enterobacteria phage T4
  MISC_FEATURE (1)..(245): I-TevI P13299.2
MKSGIYQIKNTLNNKVYVGSAKDFEKRWKRHFKDLEKGCHSSIKLQRSFNKHGNVFECSILEEIPYEKDLIIERENFWIKELNSKINGYNIADATFGDTCSTHPLKEEIIKKRSETVKAKMLKLGPDGRKALYSKPGSKNGRWNPETHKFCKCGVRIQTSAYTCSKCRNRSGENNSFFNHKHSDITKSKISEKMKGKKPSNIKKISCDGVIFDCAADAARHFKISSGLVTYRVKSDKWNWFYINA

SEQ ID NO: 350 - protein, 258 aa, Enterobacteria phage T4
  MISC_FEATURE (1)..(258): I-TevII P07072.2
  MISC_FEATURE (1)..(258): I-TevII P07072.2
MKWKLRKSLKIANSVAFTYMVRFPDKSFYIGFKKFKTIYGKDTNWKEYNSSSKLVKEKLKDYKAKWIILQVFDSYESALKHEEMLIRKYFNNEFILNKSIGGYKFNKYPDSEEHKQKLSNAHKGKILSLKHKDKIREKLIEHYKNNSRSEAHVKNNIGSRTAKKTVSIALKSGNKFRSFKSAAKFLKCSEEQVSNHPNVIDIKITIHPVPEYVKINDNIYKSFVDAAKDLKLHPSRIKDLCLDDNYPNYIVSYKRVEK

SEQ ID NO: 351 - protein, 269 aa, Enterobacteria phage RB3
  MISC_FEATURE (1)..(269): I-TevIII Q38419.1
MNYRKIWIDANGPIPKDSDGRTDEIHHKDGNRENNDLDNLMCLSIQEHYDIHLAQKDYQACHAIKLRMKYSPEEISELASKAAKSREIQIFNIPEVRAKNIASIKSKIENGTFHLLDGEIQRKSNLNRVALGIHNFQQAEHIAKVKERNIAAIKEGTHVFCGGKMQSETQSKRVNDGSHHFLSEDHKKRTSAKTLEMVKNGTHPAQKEITCDFCGHIGKGPGFYLKHNDRCKLNPNRIQLNCPYCDKKDLSPSTYKRWHGDNCKARFND

SEQ ID NO: 352 - protein, 243 aa, Staphylococcus phage Twort
  MISC_FEATURE (1)..(243): I-TwoI AAM00817.1
MEELWKEIPGFNSYMISNKGQVYSRKRNKILALRTDKNGYKRISIFNNEGKRILLGVHKLVLLGFKGINTEKPIPHHKNNIKDDNRLENLEWVTVSENTKHAYDIGALKSPRRVTCTLYYKGEPLSCYDSLFDLAKALKVSRSVIESPRNGLVLSTFEVKREPTIQGLPLNKEIFEHSLIKGLGNPPLKVYNEDETYYFLTLMDISKYFNESYSKVQRGYYKGKWKSYIIEHIDFYEYYKQTH

SEQ ID NO: 353 - protein, 262 aa, Moraxella sp.
  MISC_FEATURE (1)..(262): R.MspI P11405.1
MRTELLSKLYDDFGIDQLPHTQHGVTSDRLGKLYEKYILDIFKDIESLKKYNTNAFPQEKDISSKLLKALNLDLDNIIDVSSSDTDLGRTIAGGSPKTDATIRFTFHNQSSRLVPLNIKHSSKKKVSIAEYDVETICTGVGISDGELKELIRKHQNDQSAKLFTPVQKQRLTELLEPYRERFIRWCVTLRAEKSEGNILHPDLLIRFQVIDREYVDVTIKNIDDYVSDRIAEGSKARKPGFGTGLNWTYASGSKAKKMQFKG

SEQ ID NO: 354 - protein, 246 aa, Kocuria varians
  MISC_FEATURE (1)..(246): R.MvaI
MSEYLNLLKEAIQNVVDGGWHETKRKGNTGIGKTFEDLLEKEEDNLDAPDFHDIEIKTHETAAKSLLTLFTKSPTNPRGANTMLRNRYGKKDEYGNNILHQTVSGNRKTNSNSYNYDFKIDIDWESQVVRLEVFDKQDIMIDNSVYWSFDSLQNQLDKKLKYIAVISAESKIENEKKYYKYNSANLFTDLTVQSLCRGIENGDIKVDIRIGAYHSGKKKGKTHDHGTAFRINMEKLLEYGEVKVIV

SEQ ID NO: 355 - protein, 274 aa, Nostoc sp. PCC 7120
  MISC_FEATURE (1)..(274): NucA CAA45962.1
MGICGKLGVAALVALIVGCSPVQSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDN

SEQ ID NO: 356 - protein, 232 aa, Dickeya dadantii 3937
  MISC_FEATURE (1)..(232): NucM P37994.2
MLRNLVIFAVLGAGLTTLAAAGQDINNFTQAKAAAAKIHQDAPGTFYCGCKINWQGKKGTPDLASCGYQVRKDANRASRIEWEHVVPAWQFGHQRQCWQDGGRKNCTKDDVYRQIETDLHNLQPAIGEVNGDRGNFMYSQWNGGERQYGQCEMKIDFKSQLAEPPERARGAIARTYFYMRDRYNLNLSRQQTQLFDAWNKQYPATTWECTREKRIAAVQGNHNPYVQQACQP

SEQ ID NO: 357 - protein, 231 aa, Vibrio vulnificus
  MISC_FEATURE (1)..(231): Vvn AAF19759.1
MKRLFIFIASFTAFAIQAAPPSSFSAAKQQAVKIYQDHPISFYCGCDIEWQGKKGIPNLETCGYQVRKQQTRASRIEWEHVVPAWQFGHHRQCWQKGGRKNCSKNDQQFRLMEADLHNLTPAIGEVNGDRSNFNFSQWNGVDGVSYGRCEMQVNFKQRKVMPQTELRGSIARTYLYMSQEYGFQLSKQQQQLMQAWNKSYPVDEWECTRDDRIAKIQGNHNPFVQQSCQTQ

SEQ ID NO: 358 - protein, 222 aa, artificial sequence
  Synthetic polypeptide: Vvn_CLS
MASGAPPSSFSAAKQQAVKIYQDHPISFYCGCDIEWQGKKGIPNLETCGYQVRKQQTRASRIEWEHVVPAWQFGHHRQCWQKGGRKNCSKNDQQFRLMEADLHNLTPAIGEVNGDRSNFNFSQWNGVDGVSYGRCEMQVNFKQRKVMPPDRARGSIARTYLYMSQEYGFQLSKQQQQLMQAWNKSYPVDEWECTRDDRIAKIQGNHNPFVQQSCQTQGSSAD

SEQ ID NO: 359 - protein, 231 aa, Staphylococcus aureus
  MISC_FEATURE (1)..(231): Staphylococcal nuclease (NUC_STAAU) P00644.1
MLVMTEYLLSAGICMAIVSILLIGMAISNVSKGQYAKRFFFFATSCLVLTLVVVSSLSSSANASQTDNGVNRSGSEDPTVYSATSTKKLHKEPATLIKAIDGDTVKLMYKGQPMTFRLLLVDTPETKHPKKGVEKYGPEASAFTKKMVENAKKIEVEFDKGQRTDKYGRGLAYIYADGKMVNEALVRQGLAKVAYVYKPNNTHEQHLRKSEAQAKKEKLNIWSEDNADSGQ

SEQ ID NO: 360 - protein, 169 aa, Staphylococcus hyicus
  MISC_FEATURE (1)..(169): Staphylococcal nuclease (NUC_STAHY) P43270.1
MKKITTGLIIVVAAIIVLSIQFMTESGPFKSAGLSNANEQTYKVIRVIDGDTIIVDKDGKQQNLRMIGVDTPETVKPNTPVQPYGKEASDFTKRHLTNQKVRLEYDKQEKDRYGRTLAYVWLGKEMFNEKLAKEGLARAKFYRPNYKYQERIEQAQKQAQKLKKNIWSN

SEQ ID NO: 361 - protein, 174 aa, Salmonella enterica
  MISC_FEATURE (1)..(174): Micrococcal nuclease (NUC_SHIFL)P29769.1
MKSALAALRAVAAAVVLIVSVPAWADFRGEVVRILDGDTIDVLVNRQTIRVRLADIDAPESGQAFGSRARQRLADLTFRQEVQVTEKEVDRYGRTLGVVYAPLQYPGGQTQLTNINAIMVQEGMAWAYRYYGKPTDAQMYEYEKEARRQRLGLWSDPNAQEPWKWRRASKNATN

SEQ ID NO: 362 - protein, 211 aa, Bacillus subtilis
  MISC_FEATURE (1)..(211): Endonuclease yncB P94492.1
MKKILISMIAIVLSITLAACGSNHAAKNHSDSNGTEQVSQDTHSNEYNQTEQKAGTPHSKNQKKLVNVTLDRAIDGDTIKVIYNGKKDTVRYLLVDTPETKKPNSCVQPYGEDASKRNKELVNSGKLQLEFDKGDRRDKYGRLLAYVYVDGKSVQETLLKEGLARVAYVYEPNTKYIDQFRLDEQEAKSDKLSIWSKSGYVTNRGFNGCVK

SEQ ID NO: 363 - protein, 149 aa, Enterobacteria phage T7
  MISC_FEATURE (1)..(149): Endodeoxyribonuclease I (ENRN_BPT7)P00641.1
MAGYGAKGIRKVGAFRSGLEDKVSKQLESKGIKFEYEEWKVPYVIPASNHTYTPDFLLPNGIFVETKGLWESDDRKKHLLIREQHPELDIRIVFSSSRTKLYKGSPTSYGEFCEKHGIKFADKLIPAEWIKEPKKEVPFDRLKRKGGKK

SEQ ID NO: 364 - protein, 671 aa, Homo sapiens
  MISC_FEATURE (1)..(671): Metnase Q53H47.1
MAEFKEKPEAPTEQLDVACGQENLPVGAWPPGAAPAPFQYTPDHVVGPGADIDPTQITFPGCICVKTPCLPGTCSCLRHGENYDDNSCLRDIGSGGKYAEPVFECNVLCRCSDHCRNRVVQKGLQFHFQVFKTHKKGWGLRTLEFIPKGRFVCEYAGEVLGFSEVQRRIHLQTKSDSNYIIAIREHVYNGQVMETFVDPTYIGNIGRFLNHSCEPNLLMIPVRIDSMVPKLALFAAKDIVPEEELSYDYSGRYLNLTVSEDKERLDHGKLRKPCYCGAKSCTAFLPFDSSLYCPVEKSNISCGNEKEPSMCGSAPSVFPSCKRLTLETMKMMLDKKQIRAIFLFEFKMGRKAAETTRNINNAFGPGTANERTVQWWFKKFCKGDESLEDEERSGRPSEVDNDQLRAIIEADPLTTTREVAEELNVNHSTVVRHLKQIGKVKKLDKWVPHELTENQKNRRFEVSSSLILRNHNEPFLDRIVTCDEKWILYDNRRRSAQWLDQEEAPKHFPKPILHPKKVMVTIWWSAAGLIHYSFLNPGETITSEKYAQEIDEMNQKLQRLQLALVNRKGPILLHDNARPHVAQPTLQKLNELGYEVLPHPPYSPDLLPTNYHVFKHLNNFLQGKRFHNQQDAENAFQEFVESQSTDFYATGINQLISRWQKCVDCNGSYFD

SEQ ID NO: 365 - protein, 488 aa, Geobacillus stearothermophilus
  MISC_FEATURE (1)..(488): Nb.BsrDI ABD15132.1
MTEYDLHLYADSFHEGHWCCENLAKIAQSDGGKHQIDYLQGFIPRHSLIFSDLIINITVFGSYKSWKHLPKQIKDLLFWGKPDFIAYDPKNDKILFAVEETGAVPTGNQALQRCERIYGSARKQIPFWYLLSEFGQHKDGGTRRDSIWPTIMGLKLTQLVKTPSIILHYSDINNPEDYNSGNGLKFLFKSLLQIIINYCTLKNPLKGMLELLSIQYENMLEFIKSQWKEQIDFLPGEEILNTKTKELARMYASLAIGQTVKIPEELFNWPRTDKVNFKSPQGLIKYDELCYQLEKAVGSKKAYCLSNNAGAKPQKLESLKEWINSQKKLFDKAPKLTPPAEFNMKLDAFPVTSNNNYYVTTSKNILYLFDYWKDLRIAIETAFPRLKGKLPTDIDEKPALIYICNSVKPGRLFGDPFTGQLSAFSTIFGKKNIDMPRIVVAYYPHQIYSQALPKNNKSNKGITLKKELTDFLIFHGGVVVKLNEGKAY

SEQ ID NO: 366 - protein, 217 aa, Geobacillus stearothermophilus
  MISC_FEATURE (1)..(217): BsrDI A ABD15133.1
MTDYRYSFELSEEIARWAFEIKTKNTDWFVAFSNPTAGPWKRVMAIDKASNREGEVHRFGREDERPDIILVNDNISLILILEAKEKLNQLISKSQVDKSVDVFLTLSSILKEKSDNNYWGDRTKYINVLGILWGSEQETSQKDIDNAFRVYRDSLVKNLKEINPTPTNICTDILVGVESIKNKKEEISIKIHVSNIYAEIYPKFTGKHLLEKLAVLN

SEQ ID NO: 367 - protein, 604 aa, Bacillus sp. D6
  MISC_FEATURE (1)..(604): Nt.BspD6I ABN42182.1 (R.BspD6I large subunit)
MAKKVNWYVSCSPRSPEKIQPELKVLANFEGSYWKGVKGYKAQEAFAKELAALPQFLGTTYKKEAAFSTRDRVAPMKTYGFVFVDEEGYLRITEAGKMLANNRRPKDVFLKQLVKWQYPSFQHKGKEYPEEEWSINPLVFVLSLLKKVGGLSKLDIAMFCLTATNNNQVDEIAEEIMQFRNEREKIKGQNKKLEFTENYFFKRFEKIYGNVGKIREGKSDSSHKSKIETKMRNARDVADATTRYFRYTGLFVARGNQLVLNPEKSDLIDEIISSSKVVKNYTRVEEFHEYYGNPSLPQFSFETKEQLLDLAHRIRDENTRLAEQLVEHFPNVKVEIQVLEDIYNSLNKKVDVETLKDVIYHAKELQLELKKKKLQADFNDPRQLEEVIDLLEVYHEKKNVIEEKIKARFIANKNTVFEWLTWNGFIILGNALEYKNNFVIDEELQPVTHAAGNQPDMEIIYEDFIVLGEVTTSKGATQFKMESEPVTRHYLNKKKELEKQGVEKELYCLFIAPEINKNTFEEFMKYNIVQNTRIIPLSLKQFNMLLMVQKKLIEKGRRLSSYDIKNLMVSLYRTTIECERKYTQIKAGLEETLNNWVVDKEVRF

SEQ ID NO: 368 - protein, 186 aa, Bacillus sp. D6
  MISC_FEATURE (1)..(186): ss.BspD6I (R.BspD6I small subunit)
MQDILDFYEEVEKTINPPNYFEWNTYRVFKKLGSYKNLVPNFKLDDSGHPIGNAIPGVEDILVEYEHFSILIECSLTIGEKQLDYEGDSVVRHLQEYKKKGIEAYTLFLGKSIDLSFARHIGFNKESEPVIPLTVDQFKKLVTQLKGDGEHFNPNKLKEILIKLLRSDLGYDQAEEWLTFIEYNLK

SEQ ID NO: 369 - protein, 555 aa, Paucimonas lemoignei
  MISC_FEATURE (1)..(555): R.PleI AAK27215.1
MAKPIDSKVLFITTSPRTPEKMVPEIELLDKNFNGDVWNKDTQTAFMKILKEESFFDGEGKNDPAFSARDRINRAPKSLGFVILTPKLSLTDAGVELIKAKRKDDIFLRQMLKFQLPSPYHKLSDKAALFYVKPYLEIFRLVRHFGSLTFDELMIFGLQIIDFRIFNQIVDKIEDFRVGKIENKGRYKTYKKERFEEELGKIYKDELFGLTEASAKTLITKKGNNMRDYADACVRYLRATGMVNVSYQGKSLSIVQEKKEEVDFFLKNTEREPCFINDEASYVSYLGNPNYPKLFVDDVDRIKKKLRFDFKKTNKVNALTLPELKEELENEILSRKENILKSQISDIKNFKLYEDIQEVFEKIENDRTLSDAPLMLEWNTWRAMTMLDGGEIKANLKFDDFGSPMSTAIGNMPDIVCEYDDFQLSVEVTMASGQKQYEMEGEPVSRHLGKLKKSSEKPVYCLFIAPKINPSSVAHFFMSHKVDIEYYGGKSLIIPLELSVFRKMIEDTFKASYIPKSDNVHKLFKNFASIADEAGNEKVWYEGVKRTAMNWLSLS

SEQ ID NO: 370 - protein, 556 aa, Micrococcus lylae
  MISC_FEATURE (1)..(556): MlyI AAK39546.1
MASLSKTKHLFGFTSPRTIEKIIPELDILSQQFSGKVWGENQINFFDAIFNSDFYEGTTYPQDPALAARDRITRAPKALGFIQLKPVIQLTKAGNQLVNQKRLPELFTKQLLKFQLPSPYHTQSPTVNFNVRPYLELLRLINELGSISKTEIALFFLQLVNYNKFDEIKNKILKFRETRKNNRSVSWKTYVSQEFEKQISIIFADEVTAKNFRTRESSDESFKKFVKTKEGNMKDYADAFFRYIRGTQLVTIDKNLHLKISSLKQDSVDFLLKNTDRNALNLSLMEYENYLFDPDQLIVLEDNSGLINSKIKQLDDSINVESLKIDDAKDLLNDLEIQRKAKTIEDTVNHLKLRSDIEDILDVFAKIKKRDVPDVPLFLEWNIWRAFAALNHTQAIEGNFIVDLDGMPLNTAPGKKPDIEINYGSFSCIVEVTMSSGETQFNMEGSSVPRHYGDLVRKVDHDAYCIFIAPKVAPGTKAHFFNLNRLSTKHYGGKTKIIPMSLDDFICFLQVGITHNFQDINKLKNWLDNLINFNLESEDEEIWFEEIISKISTWAI

SEQ ID NO: 371 - protein, 543 aa, Geobacillus sp. Y412MC52
  MISC_FEATURE (1)..(543): AlwI YP_004134094.1
MNKKNTRKVWFITRPERDPRFHQEALLALQKATDDFRLKWAGNREVHKRYEEELANMGIKRNNVSHDGSGGRTWMAMLKTFSYCYVDDDGYIRLTKVGEKLIQGEKVYENTRKQVLTLQYPNAYFLEPGFRPKFDEGFRIRPVLFLIKLANDERLDFYVTKEEITYFAMTAQKDSQLDEIVHKILAFRKAGPREREEMKQDIAAKFDHRERSDKGARDFYEAHSDVAHTFMLISDYTGLVEYIRGKALKGDSSKINEIKQEIAEIEKRYPFNTRYMISLERMAENSGLDVDSYKASRYGNIKPAANSSKLRAKAERILAQFPSIESMSKEEIAGALQKYLSPRDIEKVIHEIVENKDDFEGINSDFVETYLNEKDNLAFEDKTGQIFSALGFDVAMRPKAKNGERTEIEIIARYGGSKFGIIDAKNYAGKFPLSSSLVSHMASEYIPNYTGYEGKELTFFGYVTANDFSGERNLEKISDKAKRITGNPISGFLVTARTLLGFLDYCIENDVPLEDRAELFVKAVKNKGYKSLEALLRELKETI

SEQ ID NO: 372 - protein, 685 aa, Kocuria varians
  MISC_FEATURE (1)..(685): Mva1269I AAY97906.1
MYLNTAVFNIYGDNIVECSRAFHYILEGFKLANISITQEYDLQNITTPKFCIYTDKFRYIFIFIPGTSASRWNKDIYKELVLNNGGPLKEGADAIITRIFSEDSELVLASMEFSAALPAGNNTWQRSGRAYSLTAANIPYFYIVQLGGKEIKKGKDGKSDKFATRLPNPALSLSFTLNTIKKPAPSLIVYDQAPEADSAISDLYSNCYGIDDFSLYLFKLITEENNLHELKNIYNKNVEFLQLRSVDEKGKNFSGKDYKYIFEHKDPYKGLTEVVKERKIPWKKKTATKTFENFPLRNQAPIFRLIDFLSTKSYGIVSKDSLPLTFIPSEHRVEVANYICNQLYIDKVSDEFVKWIYKKEDLAICIINGFKPGGDDSRPDRGLPPFTKMLTNLDILTLMFGPAPPTQWDYLDSDPEKLNKTNGLWQSIFAFSDAILVDSSTRDNNKFVYNAYLKEHWVVQREKKESNTPISYFPKSVGEHDVDTSLHILFTYIGKHFESACNPPGGDWSGVSLLKNNIEYRWTSMYRVSQDGTKRPDHIYQLVYNSTDTLLLIESKGIKNDLLKSKEANVGIGMINYLKNLMARDYTAVKKDGEWKNIHGQMTLDKFLTFSAVAYLFTTDFDNEYTSAAELLVHSNTQLAFALEIKEKNSVMHIFTANTVAYNFAEYLLETMRNSHLPLKIYKPI

SEQ ID NO: 373 - protein, 599 aa, Geobacillus stearothermophilus
  MISC_FEATURE (1)..(599): BsrI ADR72996.1
MRNIRIYSEVKEQGIFFKEVIQSVLEKANVEVVLVNSAMLDYSDVSVISLIRNQKKFDLLVSEVRDKREIPIVMVEFSTAVTTDDHELQRADAMFWAYKYKIPYLKISPMEKKSQTADDKFGGGRLLSVNDQIIHMYRTDGVMYHIEWESMDNSAYVKNAELYPSCPDCAPELASLFRCLLETIEKCENIEDYYRILLDKLGKQKVAVKWGNFREEKTLEQWKHEKFDLLERFSKSSSRMEYDKDKKELKIKVNRYGHAMDPERGILAFWKLVLGDEWKIVAEFQLQRKTLKGRQSYQSLFDEVSQEEKLMNIASEIIKNGNVISPDKAIEIHKLATSSTMISTIDLGTPERKYITDDSLKGYLQHGLITNIYKNLLYYVDEIRFTDLQRKTIASLTWNKEIVNDYYKSLMDQLLDKNLRVLPLTSIKNISEDLITWSSKEILINLGYKILAASYPEAQGDRCILVGPTGKKTERKFIDLIAISPKSKGVILLECKDKLSKSKDDCEKMNDLLNHNYDKVTKLINVLNINNYNYNNIIYTGVAGLIGRKNVDNLPVDFVIKFKYDAKNLKLNWEINSDILGKHSGSFSMEDVAVVRKRS

SEQ ID NO: 374 - protein, 676 aa, Geobacillus stearothermophilus
  MISC_FEATURE (1)..(676): BsmI AAL86024.1
MNVFRIHGDNIIECERVIDLILSKINPQKVKRGFISLSCPFIEIIFKEGHDYFHWRFDMFPGFNKNTNDRWNSNILDLLSQKGSFLYETPDVIITSLNNGKEEILMAIEFCSALQAGNQAWQRSGRAYSVGRTGYPYIYIVDFVKYELNNSDRSRKNLRFPNPAIPYSYISHSKNTGNFIVQAYFRGEEYQPKYDKKLKFFDETIFAEDDIADYIIAKLQHRDTSNIEQLLINKNLKMVEFLSKNTKNDNNFTYSEWESIYNGTYRITNLPSLGRFKFRKKIAEKSLSGKVKEFNNIVQRYSVGLASSDLPFGVIRKESRNDFINDVCKLYNINDMKIIKELKEDADLIVCMLKGFKPRGDDNRPDRGALPLVAMLAGENAQIFTFIYGPLIKGAINLIDQDINKLAKRNGLWKSFVSLSDFIVLDCPIIGESYNEFRLIINKNNKESILRKTSKQQNILVDPTPNHYQENDVDTVIYSIFKYIVPNCFSGMCNPPGGDWSGLSIIRNGHEFRWLSLPRVSENGKRPDHVIQILDLFEKPLLLSIESKEKPNDLEPKIGVQLIKYIEYLFDFTPSVQRKIAGGNWEFGNKSLVPNDFILLSAGAFIDYDNLTENDYEKIFEVTGCDLLIAIKNQNNPQKWVIKFKPKNTIAEKLVNYIKLNFKSNIFDTGFFHIEG

SEQ ID NO: 375 - protein, 465 aa, artificial sequence
  synthetic polypeptide: Nb.BtsCI ADI24225.1
MKRILYLLTEERPKINIIHQIINLEYKATLHFGAKIVPVMNEENKFTFIYHVKGIEVEGFDAVLIKIVSGHSSFVDYLVFDSNDLKPEKNTITLFDLDQYELDLSYYFGKGWIVRIPSPSDLPKYVVEETKTDDHESRNTNAYQRSSKFVFCELYYGKEVKKYMLYDISDGRTLSGTDTHNFGMRMLVTNNVNLVGVPNMYLPFTDIKEFINEKNRIADNGPSHNVPIRLKLDKEKNVIYISAKLDKGNGKNKNKISNDPNIGAVAIISATLRNLNWKGDIEIINHNLLPSSISSRSNGNKLLYIMKKLGVRFNNINVNWNNIKNNINYFFYNITSEKIVSIYYHLYVEDKLSNARVIFDNHAGCGKSYFRTLNNKIIPVGKEIPLPALVIFDSDQNIVKVIAAAKAENVYNGVEQLSTFDKFIESYINKYYPGAAVECSVITWGKSSNPYVSFYLDKDGSAVFL

SEQ ID NO: 376 - protein, 465 aa, artificial sequence
  synthetic polypeptide: Nt.BtsCI ADI24224.1
MKRILYLLTEERPKINIIHQIINLEYKATLHFGAKIVPVMNEENKFTFIYHVKGIEVEGFDAVLIKIVSGHSSFVDYLVFDSNDLKPEKNTITLFDLDQYELDLSYYFGKGWIVRIPSPSDLPKYVVFETKTDDHESRNTNAYQRSSKFVFCELYYGKEVKKYMLYDISDGRTLSGTDTHNFGMRMLVTNNVNLVGVPNMYLPFTDIKEFINEKNRIADNGPSHNVPIRLKLDKEKNVIYISAKLDKGNGKNKNKISNDPNIGAVAIISATLRNLNWKGDIEIINHNLLPSSISSRSNGNKLLYIMKKLGVRFNNINVNWNNIKNNINYFFYNITSEKIVSIYYHLYVEDKLSNARVIFDNHAGCGKSYFRTLNNKIIPVGKEIPLPDLVIFDSDQNIVKVIEAEKAENVYNGVEQLSTFDKFIESYINKYYPGAAVECSVITWGKSSNPYVSFYLDKDGSAVFL

SEQ ID NO: 377 - protein, 164 aa, Geobacillus thermoglucosidasius
  MISC_FEATURE (1)..(164): R1.BtsI ABC75874.1
MKITEGIVHVAMRHFLKSNGWKLIAGQYPGGSDDELTALNIVDPVVARDNSPDPRRHSLGKIVPDLIAYKNDDLLVIEAKPKYSQDDRDKLLYLLSERKHDFYAALEKFATERNHPELLPVSKLNIIPGLAFSASENKFKKDPGFVYIRVSGIFEAFMEGYDWG

SEQ ID NO: 378 - protein, 328 aa, Geobacillus thermoglucosidasius
  MISC_FEATURE (1)..(328): R2.BtsI ABC75876.1
MQIEQLMKSLTIYFDDIQEGLWFKNLHPLLESASLEAITGSLKRNPNLADVLKYDRPDIILTLNQTPILVIERTIEVPSGHNVGQRYGRLAAASEAGVPLVYFGPYAARKHGGATEGPRYMNLRLFYALDVMQKVNGSAITTINWPVDQNFEILQDPSKDKRMKEYLEMFFDNLLKYGIAGINLAIRNSSFQAEQLAEREKFVETMITNPEQYDVPPDSVQILNAERFFNELGISENKRIICDEVVLYQVGMTYVRSDPYTGMALLYKYLYILGSERNRCLILKFPNITTDMWKKVAFGSRERKDVRIYRSVSDGILFADGYLSKEEL

SEQ ID NO: 379 - protein, 275 aa, Brevibacillus brevis
  MISC_FEATURE (1)..(275): BbvCI subunit 1 AAX14652.1
MINEDFFIYEQLSHKKNLEQKGKNAFDEETEELVRQAKSGYHAFIEGINYDEVTKLDLNSSVAALEDYISIAKEIEKKHKMFNWRSDYAGSIIPEFLYRIVHVATVKAGLKPIFSTRNTIIEISGAAHREGLQIRRKNEDFALGFHEVDVKIASESHRVISLAVACEVKTNIDKNKLNGLDFSAERMKRTYPGSAYFLITETLDFSPDENHSSGLIDEIYVLRKQVRTKNRVQKAPLCPSVFAELLEDILEISYRASNVKGHVYDRLEGGKLIRV

SEQ ID NO: 380 - protein, 285 aa, Brevibacillus brevis
  MISC_FEATURE (1)..(285): BbvCI subunit 2 AAX14653.1
MFNQFNPLVYTHGGKLERKSKKDKTASKVFEEFGVMEAYNCWKEASLCIQQRDKDSVLKLVAALNTYKDAVEPIFDSRLNSAQEVLQPSILEEFFEYLFSRIDSIVGVNIPIRHPAKGYLSLSFNPHNIETLIQSPEYTVRAKDHDFIIGGSAKLTIQGHGGEGETTNIVVPAVAIECKRYLERNMLDECAGTAERLKRATPYCLYFVVAEYLKLDDGAPELTEIDEIYILRHQRNSERNKPGFKPNPIDGELIWDLYQEVMNHLGKIWWDPNSALQRGKVFNRP

SEQ ID NO: 381 - protein, 294 aa, Bacillus pumilus
  MISC_FEATURE (1)..(294): Bpu10I alpha subunit CAA74998.1
MGVEQEWIKNITDMYQSPELIPSHASNLLHQLKREKRNEKLKKALEIITPNYISYISILLNNHNMTRKEIVILVDALNEYMNTLRHPSVKSVFSHQADFYSSVLPEFFNLLFRNLIKGLNEKIKVNSQKDIIIDCIFDPYNEGRVVFKKKRVDVAIILKNKFVFNNVEISDFAIPLVAIEIKTNLDKNMLSGIEQSVDSLKETFPLCLYYCITELADFAIEKQNYASTHIDEVFILRKQKRGPVRRGTPLEVVHADLILEVVEQVGEHLSKFKDPIKTLKARMTEGYLIKGKGK

SEQ ID NO: 382 - protein, 288 aa, Bacillus pumilus
  MISC_FEATURE (1)..(288): Bpu10I beta subunit CAA74999.1
MTQIDLSNTKHGSILFEKQKNVKEKYLQQAYKHYLYFRRSIDGLEITNDEAIFKLTQAANNYRDNVLYLFESRPNSGQEAFRYTILEEFFYHLFKDLVKKKFNQEPSSIVMGKANSYVSLSFSPESFLGLYENPIPYIHTKDQDFVLGCAVDLKISPKNELNKENETEIVVPVIAIECKTYIERNMLDSCAATASRLKAAMPYCLYIVASEYMKMDQAYPELTDIDEVFILCKASVGERTALKKKGLPPHKLDENLMVELFHMVERHLNRVWWSPNEALSRGRVIGRP

SEQ ID NO: 383 - protein, 358 aa, Bacillus megaterium
  MISC_FEATURE (1)..(358): BmrI ABM69266.1
MNYFSLHPNVYATGRPKGLINMLESVWISNQKPGDGTMYLISGFANYNGGIRFYETFTEHINHGGKVIAILGGSTSQRLSSKQVVAELVSRGVDVYIINRKRLLHAKLYGSSSNSGESLVVSSGNFTGPGMSQNVEASLLLDNNTTSSMGFSWNGMVNSMLDQKWQIHNLSNSNPTSPSWNLLYDERTTNLTLDDTQKVTLILTLGHADTARIQAAPKSKAGEGSQYFWLSKDSYDFFPPLTIRNKRGTKATYSCLINMNYLDIKYIDSECRVTFEAENNFDFRLGTGKLRYTNVAASDDIAAITRVGDSDYELRIIKKGSSNYDALDSAAVNFIGNRGKRYGYIPNDEFGRIIGAKF

SEQ ID NO: 384 - protein, 358 aa, Bacillus firmus
  MISC_FEATURE (1)..(358): BfiI CAC12783.1
MNFFSLHPNVYATGRPKGLIGMLENVWVSNHTPGEGTLYLISGFSNYNGGVRFYETFTEHINQGGRVIAILGGSTSQRLSSRQVVEELLNRGVEVHIINRKRILHAKLYGTSNNLGESLVVSSGNFTGPGMSQNIEASLLLDNNTTQSMGFSWNDMISEMLNQNWHIHNMTNATDASPGWNLLYDERTTNLTLDETERVTLIVTLGHADTARIQAAPGTTAGQGTQYFWLSKDSYDFFPPLTIRNRRGTKATYSSLINMNYIDINYTDTQCRVTFEAENNFDFRLGTGKLRYTGVAKSNDIAAITRVGDSDYELRIIKQGTPEHSQLDPYAVSFIGNRGKRFGYISNEEFGRIIGVTF

SEQ ID NO: 385 - protein, 163 aa, Chlamydomonas reinhardtii
  MISC_FEATURE (1)..(163)
MNTKYNKEFLLYLAGFVDGDGSIIAQIKPNQSYKFKHQLSLTFQVTQKTQRRWFLDKLVDEIGVGYVRDRGSVSDYILSEIKPLHNFLTQLQPFLKLKQKQANLVLKIIEQLPSAKESPDKFLEVCTWVDQIAALNDSKTRKTTSETVRAVLDSLSEKKKSSP

SEQ ID NO: 386 - protein, 846 aa, Homo sapiens
  MISC_FEATURE (1)..(846): hExoI (EXO1_HUMAN)  Q9UQ84.2
MGIQGLLQFIKEASEPIHVRKYKGQVVAVDTYCWLHKGAIACAEKLAKGEPTDRYVGFCMKFVNMLLSHGIKPILVFDGCTLPSKKEVERSRRERRQANLLKGKQLLREGKVSEARECFTRSINITHAMAHKVIKAARSQGVDCLVAPYEADAQLAYLNKAGIVQAIITEDSDLLAFGCKKVILKMDQFGNGLEIDQARLGMCRQLGDVFTEEKFRYMCILSGCDYLSSLRGIGLAKACKVLRLANNPDIVKVIKKIGHYLKMNITVPEDYINGFIRANNTFLYQLVFDPIKRKLIPLNAYEDDVDPETLSYAGQYVDDSIALQIALGNKDINTFEQIDDYNPDTAMPAHSRSHSWDDKTCQKSANVSSIWHRNYSPRPESGTVSDAPQLKENPSTVGVERVISTKGLNLPRKSSIVKRPRSAELSEDDLLSQYSLSFTKKTKKNSSEGNKSLSFSEVFVPDLVNGPTNKKSVSTPPRTRNKFATFLQRKNEESGAVVVPGTRSRFFCSSDSTDCVSNKVSIQPLDETAVTDKENNLHESEYGDQEGKRLVDTDVARNSSDDIPNNHIPGDHIPDKATVFTDEESYSFESSKFTRTISPPTLGTLRSCFSWSGGLGDFSRTPSPSPSTALQQFRRKSDSPTSLPENNMSDVSQLKSEESSDDESHPLREEACSSQSQESGEFSLQSSNASKLSQCSSKDSDSEESDCNIKLLDSQSDQTSKLRLSHFSKKDTPLRNKVPGLYKSSSADSLSTTKIKPLGPARASGLSKKPASIQKRKHHNAENKPGLQIKLNELWKNFGFKKDSEKLPPCKKPLSPVRDNIQLTPEAEEDIFNKPECGRVQRAIFQ

SEQ ID NO: 387 - protein, 702 aa, Saccharomyces cerevisiae
  MISC_FEATURE (1)..(702): Yeast ExoI (EXO1_YEAST) P39875.2
MGIQGLLPQLKPIQNPVSLRRYEGEVLAIDGYAWLHRAACSCAYELAMGKPTDKYLQFFIKRFSLLKTFKVEPYLVFDGDAIPVKKSTESKRRDKRKENKAIAERLWACGEKKNAMDYFQKCVDITPEMAKCIICYCKLNGIRYIVAPFEADSQMVYLEQKNIVQGIISEDSDLLVFGCRRLITKLNDYGECLEICRDNFIKLPKKFPLGSLTNEEIITMVCLSGCDYTNGIPKVGLITAMKLVRRFNTIERIILSIQREGKLMIPDTYINEYEAAVLAFQFQRVFCPIRKKIVSLNEIPLYLKDTESKRKRLYACIGFVIHRETQKKQIVHFDDDIDHHLHLKIAQGDLNPYDFHQPLANREHKLQLASKSNIEFGKTNTTNSEAKVKPIESFFQKMTKLDHNPKVANNIHSLRQAEDKLTMAIKRRKLSNANVVQETLKDTRSKFFNKPSMTVVENFKEKGDSIQDFKEDTNSQSLEEPVSESQLSTQIPSSFITTNLEDDDNLSEEVSEVVSDIEEDRKNSEGKTIGNEIYNTDDDGDGDTSEDYSETAESRVPTSSTTSFPGSSQRSISGCTKVLQKFRYSSSFSGVNANRQPLFPRHVNQKSRGMVYVNQNRDDDCDDNDGKNQITQRPSLRKSLIGARSQRIVIDMKSVDERKSFNSSPILHEESKKRDIETTKSSQARPAVRSISLLSQFVYKGK

SEQ ID NO: 388 - protein, 475 aa, Escherichia coli DH1
  MISC_FEATURE (1)..(475): E.coli ExoI BAJ43803.1
MMNDGKQQSTFLFHDYETFGTHPALDRPAQFAAIRTDSEFNVIGEPEVFYCKPADDYLPQPGAVLITGITPQEARAKGENEAAFAARIHSLFTVPKTCILGYNNVRFDDEVTRNIFYRNFYDPYAWSWQHDNSRWDLLDVMRACYALRPEGINWPENDDGLPSFRLEHLTKANGIEHSNAHDAMADVYATIAMAKLVKTRQPRLFDYLFTHRNKHKLMALIDVPQMKPLVHVSGMFGAWRGNTSWVAPLAWHPENRNAVIMVDLAGDISPLLELDSDTLRERLYTAKTDLGDNAAVPVKLVHINKCPVLAQANTLRPEDADRLGINRQHCLDNLKILRENPQVREKVVAIFAEAEPFTPSDNVDAQLYNGFFSDADRAAMKIVLETEPRNLPALDITFVDKRIEKLLFNYRARNFPGTLDYAEQQRWLEHRRQVFTPEFLQGYADELQMLVQQYADDKEKVALLKALWQYAEEIV

SEQ ID NO: 389 - protein, 279 aa, Homo sapiens
  MISC_FEATURE (1)..(279): TREX2_HUMAN Q9BQ50.1
MGRAGSPLPRSSWPRMDDCGSRSRCSPTLCSSLRTCYPRGNITMSEAPRAETFVFLDLEATGLPSVEPEIAELSLFAVHRSSLENPEHDESGALVLPRVLDKLTLCMCPERPFTAKASEITGLSSEGLARCRKAGFDGAVVRTLQAFLSRQAGPICLVAHNGFDYDFPLLCAELRRLGARLPRDTVCLDTLPALRGLDRAHSHGTRARGRQGYSLGSLFHRYFRAEPSAAHSAEGDVHTLLLIFLHRAAELLAWADEQARGWAHIEPMYLPPDDPSLEA

SEQ ID NO: 390 - protein, 314 aa, Mus musculus
  MISC_FEATURE (1)..(314): TREX1_MOUSE Q91XB0.2
MGSQTLPHGHMQTLIFLDLEATGLPSSRPEVTELCLLAVHRRALENTSISQGHPPPVPRPPRVVDKLSLCIAPGKACSPGASEITGLSKAELEVQGRQRFDDNLAILLRAFLQRQPQPCCLVAHNGDRYDFPLLQTELARLSTPSPLDGTFCVDSIAALKALEQASSPSGNGSRKSYSLGSIYTRLYWQAPTDSHTAEGDVLTLLSICQWKPQALLQWVDEHARPFSTVKPMYGTPATTGTTNLRPHAATATTPLATANGSPSNGRSRRPKSPPPEKVPEAPSQEGLLAPLSLLTLLTLAIATLYGLFLASPGQ

SEQ ID NO: 391 - protein, 369 aa, Homo sapiens
  MISC_FEATURE (1)..(369): TREX1_HUMAN  Q9NSU2.1
MGPGARRQGRIVQGRPEMCFCPPPTPLPPLRILTLGTHTPTPCSSPGSAAGTYPTMGSQALPPGPMQTLIFFDMEATGLPFSQPKVTELCLLAVHRCALESPPTSQGPPPTVPPPPRVVDKLSLCVAPGKACSPAASEITGLSTAVLAAHGRQCFDDNLANLLLAFLRRQPQPWCLVAHNGDRYDFPLLQAELAMLGLTSALDGAFCVDSITALKALERASSPSEHGPRKSYSLGSIYTRLYGQSPPDSHTAEGDVLALLSICQWRPQALLRWVDAHARPFGTIRPMYGVTASARTKPRPSAVTTTAHLATTRNTSPSLGESRGTKDLPPVKDPGALSREGLLAPLGLLAILTLAVATLYGLSLATPGE

SEQ ID NO: 392 - protein, 315 aa, Bos taurus
  MISC_FEATURE (1)..(315): TREX1_BOVIN  Q9BG99.1
MGSRALPPGPVQTLIFLDLEATGLPFSQPKITELCLLAVHRYALEGLSAPQGPSPTAPVPPRVLDKLSLCVAPGKVCSPAASEITGLSTAVLAAHGRRAFDADLVNLIRTFLQRQPQPWCLVAHNGDRYDFPLLRAELALLGLASALDDAFCVDSIAALKALEPTGSSSEHGPRKSYSLGSVYTRLYGQAPPDSHTAEGDVLALLSVCQWRPRALLRWVDAHAKPFSTVKPMYVITTSTGTNPRPSAVTATVPLARASDTGPNLRGDRSPKPAPSPKMCPGAPPGEGLLAPLGLLAFLTLAVAMLYGLSLAMPGQ

SEQ ID NO: 393 - protein, 316 aa, Rattus norvegicus
  MISC_FEATURE (1)..(316): Rat TREX1 AAH91242.1
MGSQALPHGHMQTLIFLDLEATGLPYSQPKITELCLLAVHRHALENSSMSEGQPPPVPKPPRVVDKLSLCIAPGKPCSSGASEITGLTTAGLEAHGRQRFNDNLATLLQVFLQRQPQPCCLVAHNGDRYDFPLLQAELASLSVISPLDGTFCVDSIAALKTLEQASSPSEHGPRKSYSLGSIYTRLYGQAPTDSHTAEGDVLALLSICQWKPQALLQWVDKHARPFSTIKPMYGMAATTGTASPRLCAATTSSPLATANLSPSNGRSRGKRPTSPPPENVPEAPSREGLLAPLGLLTFLTLAIAVLYGIFLASPGQ

SEQ ID NO: 394 - protein, 829 aa, Homo sapiens
  MISC_FEATURE (1)..(829): Human DNA2 AAH63664.1
FAIPASRMEQLNELELLMEKSFWEEAELPAELFQKKVVASFPRTVLSTGMDNRYLVLAVNTVQNKEGNCEKRLVITASQSLENKELCILRNDWCSVPVEPGDIIHLEGDCTSDTWIIDKDFGYLILYPDMLISGTSIASSIRCMRRAVLSETFRSSDPATRQMLIGTVLHEVFQKAINNSFAPEKLQELAFQTIQEIRHLKEMYRLNLSQDEIKQEVEDYLPSFCKWAGDFMHKNTSTDFPQMQLSLPSDNSKDNSTCNIEVVKPMDIEESIWSPRFGLKGKIDVTVGVKIHRGYKTKYKIMPLELKTGKESNSIEHRSQVVLYTLLSQERRADPEAGLLLYLKTGQMYPVPANHLDKRELLKLRNQMAFSLFHRISKSATRQKTQLASLPQIIEEEKTCKYCSQIGNCALYSRAVEQQMDCSSVPIVMLPKIEEETQHLKQTHLEYFSLWCLMLTLESQSKDNKKNHQNIWLMPASEMEKSGSCIGNLIRMEHVKIVCDGQYLHNFQCKHGAIPVTNLMAGDRVIVSGEERSLFALSRGYVKEINMTTVTCLLDRNLSVLPESTLFRLDQEEKNCDIDTPLGNLSKLMENTFVSKKLRDLIIDFREPQFISYLSSVLPHDAKDTVACILKGLNKPQRQAMKKVLLSKDYTLIVGMPGTGKTTTICTLVPAPEQVEKGGVSNVTEAKLIVFLTSIFVKAGCSPSDIGIIAPYRQQLKIINDLLARSIGMVEVNTVDKYQGRDKSIVLVSFVRSNKDGTVGELLKDWRRLNVAITRAKHKLILLGCVPSLNCYPPLEKLLNHLNSEKLIIDLPSREHESLCHILGDFQRE

SEQ ID NO: 395 - protein, 1522 aa, Saccharomyces cerevisiae
  MISC_FEATURE (1)..(1522): DNA2YEAST  P38859.1
MPGTPQKNKRSASISVSPAKKTEEKEIIQNDSKAILSKQTKRKKKYAFAPINNLNGKNTKVSNASVLKSIAVSQVRNTSRTKDINKAVSKSVKQLPNSQVKPKREMSNLSRHHDFTQDEDGPMEEVIWKYSPLQRDMSDKTTSAAEYSDDYEDVQNPSSTPIVPNRLKTVLSFTNIQVPNADVNQLIQENGNEQVRPKPAEISTRESLRNIDDILDDIEGDLTIKPTITKFSDLPSSPIKAPNVEKKAEVNAEEVDKMDSTGDSNDGDDSLIDILTQKYVEKRKSESQITIQGNTNQKSGAQESCGKNDNTKSRGEIEDHENVDNQAKTGNAFYENEEDSNCQRIKKNEKIEYNSSDEFSDDSLIELLNETQTQVEPNTIEQDLDKVEKMVSDDLRIATDSTLSAYALRAKSGAPRDGVVRLVIVSLRSVELPKIGTQKILECIDGKGEQSSVVVRHPWVYLEFEVGDVIHIIEGKNIENKRLLSDDKNPKTQLANDNLLVLNPDVLFSATSVGSSVGCLRRSILQMQFQDPRGEPSLVMTLGNIVHELLQDSIKYKLSHNKISMEIIIQKLDSLLETYSFSIIICNEEIQYVKELVMKEHAENILYFVNKFVSKSNYGCYTSISGTRRTQPISISNVIDIEENIWSPIYGLKGFLDATVEANVENNKKHIVPLEVKTGKSRSVSYEVQGLIYTLLLNDRYEIPIEFFLLYFTRDKNMTKFPSVLHSIKHILMSRNRMSMNFKHQLQEVFGQAQSRFELPPLLRDSSCDSCFIKESCMVLNKLLEDGTPEESGLVEGEFEILTNHLSQNLANYKEFFTKYNDLITKEESSITCVNKELFLLDGSTRESRSGRCLSGLVVSEVVEHEKTEGAYIYCFSRRRNDNNSQSMLSSQIAANDFVIISDEEGHFCLCQGRVQFINPAKIGISVKRKLLNNRLLDKEKGVTTIQSVVESELEQSSLIATQNLVTYRIDKNDIQQSLSLARFNLLSLFLPAVSPGVDIVDERSKLCRKTKRSDGGNEILRSLLVDNRAPKFRDANDDPVIPYKLSKDTTLNLNQKEAIDKVMRAEDYALILGMPGTGKTTVIAEIIKILVSEGKRVLLTSYTHSAVDNILIKLRNTNISIMRLGMKHKVHPDTQKYVPNYASVKSYNDYLSKINSTSVVATTCLGINDILFTLNEKDFDYVILDEASQISMPVALGPLRYGNRFIMVGDHYQLPPLVKNDAARLGGLEESLFKTFCEKHPESVAELTLQYRMCGDIVTLSNFLIYDNKLKCGNNEVFAQSLELPMPEALSRYRNESANSKQWLEDILEPTRKVVFLNYDNCPDIIEQSEKDNITNHGEAELTLQCVEGMLLSGVPCEDIGVMTLYRAQLRLLKKIFNKNVYDGLEILTADQFQGRDKKCIIISMVRRNSQLNGGALLKELRRVNVAMTRAKSKLIIIGSKSTIGSVPEIKSFVNLLEERNWVYTMCKDALYKYKFPDRSNAIDEARKGCGKRTGAKPITSKSKFVSDKPIIKEILQEYES

SEQ ID NO: 396 - protein, 490 aa, Human herpesvirus 2
  MISC_FEATURE (1)..(490): VP16 AAA45863.1
MDLLVDDLFADRDGVSPPPPRPAGGPKNTPAAPPLYATGRLSQAQLMPSPPMPVPPAALFNRLLDDLGFSAGPALCTMLDTWNEDLFSGFPTNADMYRECKFLSTLPSDVIDWGDAHVPERSPIDIRAHGDVAFPTLPATRDELPSYYEAMAQFFRGELRAREESYRTVLANFCSALYRYLRASVRQLHRQAHMRGRNRDLREMLRTTIADRYYRETARLARVLFLHLYLFLSREILWAAYAEQMMRPDLFDGLCCDLESWRQLACLFQPLMFINGSLTVRGVPVEARRLRELNHIREHLNLPLVRSAAAEEPGAPLTTPPVLQGNQARSSGYFMLLIRAKLDSYSSVATSEGESVMREHAYSRGRTRNNYGSTIEGLLDLPDDDDAPAEAGLVAPRMSFLSAGQRPRRLSTTAPITDVSLGDELRLDGEEVDMTPADALDDFDLEMLGDVESPSPGMTHDPVSYGALDVDDFEFEQMFTDAMGIDDFGG

SEQ ID NO: 397 - protein, 840 aa, Homo sapiens
  MISC_FEATURE (1)..(840): RBBP8 retinoblastoma binding protein 8
MNISGSSCGSPNSADTSSDFKDLWTKLKECHDREVQGLQVKVTKLKQERILDAQRLEEFFTKNQQLREQQKVLHETIKVLEDRLRAGLCDRCAVTEEHMRKKQQEFENIRQQNLKLITELMNERNTLQEENKKLSEQLQQKIENDQQHQAAELECEEDVIPDSPITAFSFSGVNRLRRKENPHVRYIEQTHTKLEHSVCANEMRKVSKSSTHPQHNPNENEILVADTYDQSQSPMAKAHGTSSYTPDKSSFNLATVVAETLGLGVQEESETQGPMSPLGDELYHCLEGNHKKQPFEESTRNTEDSLRFSDSTSKTPPQEELPTRVSSPVFGATSSIKSGLDLNTSLSPSLLQPGKKKHLKTLPFSNTCISRLEKTRSKSEDSALFTHHSLGSEVNKIIIQSSNKQILINKNISESLGEQNRTEYGKDSNTDKHLEPLKSLGGRTSKRKKTEEESEHEVSCPQASFDKENAFPFPMDNQFSMNGDCVMDKPLDLSDRFSAIQRQEKSQGSETSKNKFRQVTLYEALKTIPKGFSSSRKASDGNCTLPKDSPGEPCSQECIILQPLNKCSPDNKPSLQIKEENAVFKIPLRPRESLETENVLDDIKSAGSHEPIKIQTRSDHGGCELASVLQLNPCRTGKIKSLQNNQDVSFENIQWSIDPGADLSQYKMDVTVIDTKDGSQSKLGGETVDMDCTLVSETVLLKMKKQEQKGEKSSNEERKMNDSLEDMFDRTTHEEYESCLADSFSQAADEEEELSTATKKLHTHGDKQDKVKQKAFVEPYFKGDERETSLQNFPHIEVVRKKEERRKLLGHTCKECEIYYADMPAEEREKKLASCSRHRF

SEQ ID NO: 398 - protein, 412 aa, Artificial sequence
  Synthetic polypeptide: fem-3 gi|262368139|pdb|3K5Q|
SNNVLPTWSLDSNGEMRSRLSLSEVLDSGDLMKFAVDKTGCQFLEKAVKGSLTSYQKFQLFEQVIGRKDDFLKLSTNIFGNYLVQSVIGISLATNDDGYTKRQEKLKNFISSQMTDMCLDKFACRVIQSSLQNMDLSLACKLVQALPRDARLIAICVDQNANHVIQKVVAVIPLKNWEFIVDFVATPEHLRQICSDKYGCRVVQTIIEKLTADSMNVDLTSAAQNLRERALQRLMTSVTNRCQELATNEYANYIIQHIVSNDDLAVYRECIIEKCLMRNLLSLSQEKFASHVVEKAFLHAPLELLAEMMDEIFDGYIPHPDTGKDALDIMMFHQFGNYVVQCMLTICCDAVSGRRQTKEGGYDHAISFQDWLKKLHSRVTKERHRLSRFSSGKKMIETLANLRSTHPIYELQ

SEQ ID NO: 399 - protein, 201 aa, Artificial sequence
  synthetic polypeptide: aRep gi|308387836|pdb|3LTJ|
MRGSHHHHHHTDPEKVEMYIKNLQDDSYYVRRAAAYALGKIGDERAVEPLIKALKDEDAWVRRAAADALGQIGDERAVEPLIKALKDEDGWVRQSAAVALGQIGDERAVEPLIKALKDEDWFVRIAAAFALGEIGDERAVEPLIKALKDEDGWVRQSAADALGEIGGERVRAAMEKLAETGTGFARKVAVNYLETHKSLIS

SEQ ID NO: 400 - protein, 231 aa, Artificial sequence
  synthetic polypeptide: WT Cter
SIVAQLSRPDPALAALTNDHLVALACLGGRPALDAVKKGLPHAPALIKRTNRRIPERTSHRVADHAQVVRVLGFFQCHSHPAQAFDDAMTQFGMSRHGLLQLFRRVGVTELEARSGTLPPASQRWDRILQASGMKRAKPSPTSTQTPDQASLHAFADSLERDLDAPSPMHEGDQTRASSRKRSRSDRAVTGPSAQQSFEVRVPEQRDALHLPLSWRVKRPRTSIGGGLPDP

SEQ ID NO: 401 - protein, 334 aa, Artificial sequence
  synthetic polypetide: wild type Nter
MDPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASN

SEQ ID NO: 402 - protein, 231 aa, Artificial sequence; identical to SEQ ID NO: 400
  synthetic polypeptide: wild type Cter

SEQ ID NO: 403 - DNA, 45 bp, Artificial sequence
  synthetic polynucleotide: Linker_TAL1
tctggaggttcaggttctaatgttggtagtggcagcggaagtggc

SEQ ID NO: 404 - DNA, 60 bp, Artificial sequence
  synthetic polynucleotide: Linker_TAL2
tctggaggttcaggttctttgactactaatttgactgcttttagtggcagcggaagtggc

SEQ ID NO: 405 - DNA, 66 bp, Artificial sequence
  synthetic polynucleotide: Linker_TAL3
tctggaggttcaggttctaaaagaagaactactatttctattgctgctagtggcagcggaagtggc

SEQ ID NO: 406 - DNA, 51 bp, Artificial sequence
  synthetic polynucleotide: Linker_TAL4
tctggaggttcaggttctgttggtagacaaccaagtggcagcggaagtggc

SEQ ID NO: 407 - DNA, 78 bp, Artificial sequence
  synthetic polynucleotide: Linker_TAL5
tctggaggttcaggttcttatactagattgccagaaagatctgaattgccagctgaaattagtggcagcggaagtggc

SEQ ID NO: 408 - DNA, 114 bp, Artificial sequence
  synthetic polynucleotide: Linker_TAL6
tctggaggttcaggttctattgttgttttgaatagagctgaaactccattgccattagatccaactggtaaagttaaagctgaattggatactagaagtggcagcggaagtggc

SEQ ID NO: 409 - DNA, 63 bp, Artificial sequence
  synthetic polynucleotide: Linker_TAL7
tctggaggttcaggttctactgctactccaccaggttctgttactagtggcagcggaagtggc

SEQ ID NO: 410 - DNA, 63 bp, Artificial sequence
  synthetic polynucleotide: Linker_TAL8
tctggaggttcaggttctttggataattttattaatagaccagttagtggcagcggaagtggc

SEQ ID NO: 411 - DNA, 63 bp, Artificial sequence
  synthetic polynucleotide: Linker_TAL9
tctggaggttcaggttctgtttcttctgctaaaactactgctccaagtggcagcggaagtggc

SEQ ID NO: 412 - DNA, 66 bp, Artificial sequence
  synthetic polynucleotide: Linker_TAL10
tctggaggttcaggttctgattctaaagctccaaatgcttctaatttgagtggcagcggaagtggc

SEQ ID NO: 413 - DNA, 69 bp, Artificial sequence
  synthetic polynucleotide: Linker_TAL11
tctggaggttcaggttctccagttaaaatgtttgatagacattcttctttgagtggcagcggaagtggc

SEQ ID NO: 414 - DNA, 69 bp, Artificial sequence
  synthetic polynucleotide: Linker_TAL12
tctggaggttcaggttctgctccagctgaaactaaagctgaaccaatgactagtggcagcggaagtggc

SEQ ID NO: 415 - DNA, 78 bp, Artificial sequence
  synthetic polynucleotide: Linker_TAL13
tctggaggttcaggttctgtttctactgattctactccagttactaatcaaaaatcttctagtggcagcggaagtggc

SEQ ID NO: 416 - DNA, 48 bp, Artificial sequence
  synthetic polynucleotide: Linker_TAL14
tctggaggttcaggttctgattctgttattagtggcagcggaagtggc

SEQ ID NO: 417 - DNA, 99 bp, Artificial sequence
  synthetic polynucleotide: Linker_TAL15
tctggaggttcaggttctgctagatttactttggctgttggtgataatagagttttggatatggcttctacttattttgatagtggcagcggaagtggc

SEQ ID NO: 418 - DNA, 51 bp, Artificial sequence
  synthetic polynucleotide: Linker_TAL16
tctggaggttcaggttctttgcaagaaaatttgagtggcagcggaagtggc

SEQ ID NO: 419 - DNA, 57 bp, Artificial sequence
  synthetic polynucleotide: Linker_TAL17
tctggaggttcaggttctggttatacttatattaatccaagtggcagcggaagtggc

SEQ ID NO: 420 - DNA, 78 bp, Artificial sequence
  synthetic polynucleotide: Linker_TAL18
tctggaggttcaggttcttataaattgccagctgttactactatgaaagttagaccagctagtggcagcggaagtggc

SEQ ID NO: 421 - DNA, 48 bp, Artificial sequence
  synthetic polynucleotide: Linker_TAL19
tctggaggttcaggttctttggaaggttctagtggcagcggaagtggc

SEQ ID NO: 422 - DNA, 48 bp, Artificial sequence
  Linker_TAL20
tctggaggttcaggttctattgttgaagctagtggcagcggaagtggc

SEQ ID NO: 423 - DNA, 54 bp, Artificial sequence
  synthetic polynucleotide: Linker_TAL21
tctggaggttcaggttctcaaacttatcaaccagctagtggcagcggaagtggc

SEQ ID NO: 424 - DNA, 81 bp, Artificial sequence
  Linker_TAL22
tctggaggttcaggttctattgctagaactgatttgaaaaaaaatagagattatccattggctagtggcagcggaagtggc

SEQ ID NO: 425 - DNA, 54 bp, Artificial sequence
  synthetic polynucleotide: Linker_TAL23
tctggaggttcaggttctttgccagaagaaaaaggtagtggcagcggaagtggc

SEQ ID NO: 426 - DNA, 48 bp, Artificial sequence
  synthetic polynucleotide: Linker_TAL24
tctggaggttcaggttcttatacttctactagtggcagcggaagtggc

SEQ ID NO: 427 - DNA, 60 bp, Artificial sequence
  synthetic polynucleotide: Linker_TAL25
tctggaggttcaggttcttctagaccatctgaatctgaaggtagtggcagcggaagtggc

SEQ ID NO: 428 - DNA, 51 bp, Artificial sequence
  synthetic polynucleotide: Linker_TAL26
tctggaggttcaggttctttgggtaattctttgagtggcagcggaagtggc

SEQ ID NO: 429 - DNA, 57 bp, Artificial sequence
  synthetic polynucleotide: Linker_TAL27
tctggaggttcaggttctttgactaaatataaatcttctagtggcagcggaagtggc

SEQ ID NO: 430 - DNA, 99 bp, Artificial sequence
  synthetic polynucleotide: Linker_TAL28
tctggaggttcaggttctactgaagaaccaggtgctccattgactactccaccaactttgcatggtaatcaagctagagctagtggcagcggaagtggc

SEQ ID NO: 431 - DNA, 54 bp, Artificial sequence
  synthetic polynucleotide: Linker_TAL29
tctggaggttcaggttctttttctcattctactactagtggcagcggaagtggc

SEQ ID NO: 432 - DNA, 60 bp, Artificial sequence
  synthetic polynucleotide: Linker_TAL30
tctggaggttcaggttctccagaattgaaacaaaaatcttctagtggcagcggaagtggc

SEQ ID NO: 433 - DNA, 120 bp, Artificial sequence
  synthetic polynucleotide: Linker_TAL31
tctggaggttcaggttctattttgaataaagaaaaaaaagctgtttctccattgttgttgactactactaattcttctgaaggtttgtctatgggtaattatagtggcagcggaagtggc

SEQ ID NO: 434 - DNA, 93 bp, Artificial sequence
  synthetic polynucleotide: Linker_TAL32
gaattggcagaatttcatgcccgttatgcagatttgctgcttcgtgatttgcgtgaacgtccagtgagccttgtgcgtggcccagattctggc

SEQ ID NO: 435 - DNA, 93 bp, Artificial sequence
  synthetic polynucleotide: Linker_TAL33
gaattggcagaatttcatgcccgtcctgatccattgctgcttcgtgatttgcgtgaacgtccagtgagccttgtgcgtggcctgggttctggc

SEQ ID NO: 436 - DNA, 78 bp, Artificial sequence
  synthetic polynucleotide: Linker_TAL34
gaattggcagaatttcatgcccgttatgcagatttgctgcttcgtgatttgcgtgaacgttctggcagcggaagtggc

SEQ ID NO: 437 - DNA, 93 bp, Artificial sequence
  synthetic polynucleotide: Linker_TAL35
gatatttttgactattacgcaggcgtggccgaagttatgctgggccatattgctggtcgtccagcaacccgtaaacgttggccaaactctggc

SEQ ID NO: 438 - DNA, 93 bp, Artificial sequence
  synthetic polynucleotide: Linker_TAL36
gatatttttgactattacgcaggccctgatccagttatgctgggccatattgctggtcgtccagcaacccgtaaacgttggctgggttctggc

SEQ ID NO: 439 - DNA, 78 bp, Artificial sequence
  synthetic polynucleotide: Linker_TAL37
gatatttttgactattacgcaggcgtggccgaagttatgctgggccatattgctggtcgttctggcagcggaagtggc

SEQ ID NO: 440 - DNA, 35 bp, Artificial sequence
  synthetic polynucleotide: Primer CMP_G061
cggcggccatggtggatctacgcacgctcggctac

SEQ ID NO: 441 - DNA, 36 bp, Artificial sequence
  synthetic polynucleotide: Primer CMP_G065
cgcggcggatcccggatcagggcgagataactgggc

SEQ ID NO: 442 - DNA, 3032 bp, Artificial sequence
  synthetic polynucleotide: pCLS7865
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggcaaacaccggtggatcctccggaagatcttcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 443 - DNA, 3503 bp, Artificial sequence
  synthetic polynucleotide: pCLS9009 (pCLS7865-cTAL11_CFS1)
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatcctccggaagatcttcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 444 - DNA, 9402 bp, Artificial sequence
  synthetic polynucleotide: pCLS6614
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatctggcaataccaaatataacaaagagttcctgctgtacctggccggctttgtggacggtaacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccgattacattttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 445 - DNA, 36 bp, Artificial sequence
  synthetic polynucleotide: Primer CMP_G069
gccaccggatccaagtctggcatctaccagattaag

SEQ ID NO: 446 - DNA, 35 bp, Artificial sequence
  synthetic polynucleotide: Primer CMP_G070
tggtatcggccgatggaccttgacctttcatcttg

SEQ ID NO: 447 - DNA, 9363 bp, Artificial sequence
  synthetic polynucleotide: pCLS6615
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatctggcaataccaaatataacaaagagttcctgctgtacctggccggctttgtggacggtaacggtagcatcatcgctcagattaaaccaaaccagtcttataagtttaaacatcagctaagcttgacctttcaggtgactcaaaagacccagcgccgttggtttctggacaaactagtggatgaaattggcgttggttacgtacgtgatcgcggatccgtttccgattacattttaagcgaaatcaagccgctgcacaacttcctgactcaactgcagccgtttctgaaactgaaacagaaacaggcaaacctggttctgaaaattatcgaacagctgccgtctgcaaaagaatccccggacaaattcctggaagtttgtacctgggtggatcagattgcagctctgaacgattctaagacgcgtaaaaccacttctgaaaccgttcgtgctgtgctggacagcctgagcgagaagaagaaatcctccccggcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 448 - DNA, 35 bp, Artificial sequence
  synthetic polynucleotide: Primer CMP_G071
tggtatcggccgatggaccttgagaatgcttgtgg

SEQ ID NO: 449 - DNA, 4085 bp, Artificial sequence
  synthetic polynucleotide: pCLS9010 (pCLS 7865-cT11 TevD01)
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 450 - DNA, 4046 bp, Artificial sequence
  synthetic polynucleotide: pCLS9011 (pCLS 7865-cT11 TevD02)
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 451-452 - skipped (2 entries)

SEQ ID NO: 453 - DNA, 5837 bp, Artificial sequence
  synthetic polynucleotide: pCLS9012
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 454 - DNA, 5798 bp, Artificial sequence
  synthetic polynucleotide: pCLS9013
gggcggagcctatggaaaaacgccagcaacgcggcctttttacggttcctggccttttgctggccttttgctcacatggtctttcctgcgttatcccctgattctgtggataaccgtattaccgcctttgagtgagctgataccgctcgccgcagccgaacgaccgagcgcagcgagtcagtgagcgaggaagcggagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgtcaattaaccctcactaaagggaacaaaagctgttaattaagcgcgccacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataagtcgaccaccaccaccaccaccactgataagagctcctcgagcctgcagcagctgaagctttggacttctggcgcgcccaattcgccctatagtgagtcgtattacgtcgcgctcactggccgtcgttttacaacgtcgtgactgggaaaaccctggcgttacccaacttaatcgccttgcagcacatccccctttcgccagctggcgtaatagcgaagaggcccgcaccgaaacgcccttcccaacagttgcgcagcctgaatggcgaatgggagcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttggcctgtagtgggccatagccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtggttctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggg

SEQ ID NO: 455 - DNA, 11148 bp, Artificial sequence
  synthetic polynucleotide: pCLS8523
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 456 - DNA, 11109 bp, Artificial sequence
  synthetic polynucleotide: pCLS8524
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 457 - DNA, 2850 bp, Artificial sequence
  synthetic polynucleotide: pCLS8993
atggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctgacatcaccaagtccaaaatttcaggcaagatgaaaggtcaaggtccatcggccgactga

SEQ ID NO: 458 - DNA, 2811 bp, Artificial sequence
  synthetic polynucleotide: pCLS8994
atggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatccaagtctggcatctaccagattaagaacaccctgaataacaaagtgtatgttggatctgccaaggactttgagaaaagatggaagaggcacttcaaggatctggaaaagggttgccacagctccatcaagctccaaaggtctttcaacaaacatggcaatgtctttgagtgctccattttggaagagatcccttatgaaaaggacctcattatagagagggaaaacttctggatcaaggagctgaactcaaaaatcaatggatacaacattgcagatgccacatttggtgacacctgttctactcacccccttaaggaagagatcattaaaaagaggtctgagactgtgaaggctaagatgttgaaactggggcctgatggcagaaaggcactctactctaagccaggtagcaaaaatggaaggtggaaccctgagacccacaagttctgcaaatgtggggtgagaatacagacatcagcctacacttgcagcaagtgtaggaacagatcaggagagaataactcctttttcaaccacaagcattctcaaggtccatcggccgactga

SEQ ID NO: 459 - protein, 97 aa, Artificial sequence
  synthetic polypeptide: I-TevI catalytic domain
MKSGIYQIKNTLNNKVYVGSAKDFEKRWKRHFKDLEKGCHSSIKLQRSFNKHGNVFECSILEEIPYAKDLIIERENFWIKELNSKINGYNIADATFG

SEQ ID NO: 460 - protein, 17 aa, Artificial sequence
  synthetic polypeptide: I-TevI deletion-intolerant region
DTCSTHPLKEEIIKKRS

SEQ ID NO: 461 - protein, 49 aa, Artificial sequence
  synthetic polypeptide: I-TevI deletion-tolerant region
ETVKAKMLKLGPDGRKALYSKPGSKNGRWNPETHKFCKCGVRIQTSAYT

SEQ ID NO: 462 - protein, 7 aa, Artificial sequence
  synthetic polypeptide: I-TevI zinc finger
CSKCRNR

SEQ ID NO: 463 - protein, 6 aa, Artificial sequence
  synthetic polypeptide: SGGSGS stretch
SGGSGS

SEQ ID NO: 464 - protein, 147 aa, Artificial sequence
  synthetic polypeptide: sT2 scaffold
VDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNSIVAQLSRPDP

SEQ ID NO: 465 - protein, 417 aa, Artificial sequence
  synthetic polypeptide: pCLS9937
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 466 - protein, 1001 aa, Artificial sequence
  synthetic polypeptide: pCLS9938
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 467 - DNA, 11304 bp, Artificial sequence
  synthetic polynucleotide: pCLS9924
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcccaagtcccaccattgacagagttaagtccgtctatttcggtacacttactgcttgggaatccttctggtgcaacacccacaaagctaactccagacaattacctgatggtgaagaaccagtatgccttgtcctacaataactccaagggtactgccaattgggttgcttggcaattgaactcctcttggcttggtaatgcggaaagacaggacaatttcagacctgacaaaaccttacctgcaggatgggtaagagttactccatcaatgtattccggatctggttatgatagaggtcatatagctcctagtgctgataggacgaaaactactgaggataatgccgctacctttctgatgacgaacatgatgcctcaaactccagataataaccgtaatacctggggaaacttggaagattactgtagggaattagtctcacaaggtaaagaattgtacattgttgcaggacctaatggctcattaggcaaacccttgaaagggaaagtcactgtgccaaagagtacatggaagattgtggttgttcttgattcaccaggtagtggtttggaaggtataacggcaaacacaagagtgattgctgtcaatatcccaaacgatccggagttgaacaacgattggagagcgtataaggtatcagttgacgaactagaatctttaacaggctatgactttctaagcaatgtatctcccaatatccaaaccagcatagaatcgaaagttgataatgcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 468 - DNA, 65 bp, Artificial sequence
  synthetic polynucleotide: compact target
tatataaacctaaccctcttagcatgaaggtaccttgtcgatggtgtacagtagggggagatgca

SEQ ID NO: 469 - protein, 1166 aa, Artificial sequence
  synthetic polypeptide: pCLS9596
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPSGGSGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 470 - protein, 1177 aa, Artificial sequence
  synthetic polypeptide:pCLS9597
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGDPSGGSGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 471 - protein, 1213 aa, Artificial sequence
  synthetic polypeptide:pCLS9599
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADGDPSGGSGSQVPPLTELSPSISVHLLLGNPSGATPTKLTPDNYLMVKNQYALSYNNSKGTANWVAWQLNSSWLGNAERQDNFRPDKTLPAGWVRVTPSMYSGSGYDRGHIAPSADRTKTTEDNAATFLMTNMMPQTPDNNRNTWGNLEDYCRELVSQGKELYIVAGPNGSLGKPLKGKVTVPKSTWKIVVVLDSPGSGLEGITANTRVIAVNIPNDPELNNDWRAYKVSVDELESLTGYDFLSNVSPNIQTSIESKVDNAAD

SEQ ID NO: 472 - DNA, 24 bp, Artificial sequence
  synthetic oligonucleotide: negative control target
ttgttctcaggtacctcagccaga

SEQ ID NO: 473 - protein, 135 aa, Artificial sequence
  synthetic polypeptide: NuiA protein
MTKTNSEILEQLKQASDGLLFMSESEYPFEVFLWEGSAPPVTHEIVLQQTGHGQDAPFKVVDIDSFFSRATTPQDWYEDEENAVVAKFQKLLEVIKSNLKNPQVYRLGEVELDVYVIGETPAGNLAGISTKVVET

SEQ ID NO: 474 - protein, 87 aa, Artificial sequence
  synthetic polypeptide: Im7 protein
MELKNSISDYTEAEFVQLLKEIEKENVAATDDVLDVLLEHFVKITEHPDGTDLIYYPSDNRDDSPEGIVKEIKEWRAANGKPGFKQG

SEQ ID NO: 475 - protein, 303 aa, Artificial sequence
  synthetic polypeptide:pCLS9939
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 476 - protein, 887 aa, Artificial sequence
  synthetic polypeptide: pCLS9940
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPGSSGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 477 - DNA, 10962 bp, Artificial sequence
  synthetic polynucleotide: pCLS8589
ttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgggatcctccggatctaaacgcaacaaaccaggtaaggccactggcaaaggtaaaccagtgaacaataagtggctgaacaacgctggcaaagacttgggttctccagtgccggatcgcattgccaacaagctgagagacaaagaattcaagagttttgatgactttcgcaagaaattctgggaagaagtgtctaaagatccagaactgtctaaacagtttagtcgcaacaacaatgacagaatgaaagttggtaaagctccgaagacccgcacccaagacgtgtctggcaaacgcaccagttttgaattgcatcatgaaaaaccaatctctcagaatggtggcgtttacgacatggacaacatctctgtggttactccgaaaagacatatcgatattcatcgcggtaaaggatcctcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaacatgtgagcaaaaggccagcaaaaggccaggaaccgtaaaaaggccgcgttgctggcgttt

SEQ ID NO: 478 - protein, 141 aa, Artificial sequence
  synthetic polypeptide: ColE7 catalytic domain
MASGSKRNKPGKATGKGKPVNNKWLNNAGKDLGSPVPDRIANKLRDKEFKSFDDFRKKFWEEVSKDPELSKQFSRNNNDRMKVGKAPKTRTQDVSGKRTSFELHHEKPISQNGGVYDMDNISVVTPKRHIDIHRGKGSSAD

SEQ ID NO: 479 - protein, 37 aa, Artificial sequence
  synthetic polypeptide: Linker A
SIVAQLSRPDPALVSFQKLKLACLGGRPALDAVKKGL

SEQ ID NO: 480 - protein, 37 aa, Artificial sequence
  synthetic polypeptide: Linker B
SIVAQLSRPDPAAVSAQKAKAACLGGRPALDAVKKGL

SEQ ID NO: 481 - protein, 37 aa, Artificial sequence
  synthetic polypeptide: Linker C
SIVAQLSRPDPAVVTFHKLKLACLGGRPALDAVKKGL

SEQ ID NO: 482 - protein, 44 aa, Artificial sequence
  synthetic polypeptide: Linker D
SIVAQLSRPDPAQSLAQELSLNESQIKIACLGGRPALDAVKKGL

SEQ ID NO: 483 - protein, 40 aa, Artificial sequence
  synthetic polypeptide: Linker E
SIVAQLSRPDPALQLPPLERLTLDACLGGRPALDAVKKGL

SEQ ID NO: 484 - protein, 38 aa, Artificial sequence
  synthetic polypeptide: Linker F
SIVAQLSRPDPAIHKKFSSIQMACLGGRPALDAVKKGL

SEQ ID NO: 485 - protein, 40 aa, Artificial sequence
  synthetic polypeptide: Linker G
SIVAQLSRPDPAAAAATNDHAVAAACLGGRPALDAVKKGL

SEQ ID NO: 486 - DNA, 1653 bp, Artificial sequence
  synthetic polynucleotide: pCLS9943
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccgagtggcagcggaagtggcggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 487 - DNA, 1713 bp, Artificial sequence
  synthetic polynucleotide: pCLS12233
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgctggtttccttccagaaactcaagctcgcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 488 - DNA, 1713 bp, Artificial sequence
  synthetic polynucleotide: pCLS12234
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcggcggtttccgcccagaaagctaaggccgcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 489 - DNA, 1713 bp, Artificial sequence
  synthetic polynucleotide: pCLS12235
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcggtcgtcactttccacaaactgaaactcgcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 490 - DNA, 1734 bp, Artificial sequence
  synthetic polynucleotide: pCLS12236
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgcagagtctggcacaggagctcagcctgaacgagtctcagatcaagattgcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 491 - DNA, 1722 bp, Artificial sequence
  synthetic polynucleotide: pCLS12237
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgcttcagctaccaccgcttgagagacttactcttgatgcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 492 - DNA, 1716 bp, Artificial sequence
  synthetic polynucleotide: pCLS12238
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcgatccacaaaaagtttagttccatacaaatggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 493 - DNA, 1722 bp, Artificial sequence
  synthetic polynucleotide: pCLS12270
atgggcgatcctaaaaagaaacgtaaggtcatcgattacccatacgatgttccagattacgctatcgatatcgccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccggagacgcccgggggatcaggtcacgtgcgtctcggagcattgttgcccagttatctcgccctgatccggcggccgccgcggcgaccaacgaccacgccgtcgccgccgcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 494 - DNA, 1590 bp, Artificial sequence
  synthetic polynucleotide: RVD RAGT2.3
ttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggag

SEQ ID NO: 495 - protein, 1085 aa, Artificial sequence
  synthetic polypeptide: pCLS12945
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALVSFQKLKLACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 496 - protein, 1088 aa, Artificial sequence
  synthetic polypeptide: pCLS12946
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPAAAAATNDHAVAAACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 497 - protein, 1086 aa, Artificial sequence
  synthetic polypeptide: pCLS12947
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPAIHKKFSSIQMACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 498 - protein, 1092 aa, Artificial sequence
  synthetic polypeptide: pCLS12948
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPAQSLAQELSLNESQIKIACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 499 - protein, 1088 aa, Artificial sequence
  synthetic polypeptide: pCLS12949
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPALQLPPLERLTLDACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 500 - protein, 1085 aa, Artificial sequence
  synthetic polypeptide: pCLS12950
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPAAVSAQKAKAACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 501 - protein, 1085 aa, Artificial sequence
  synthetic polypeptide: pCLS12951
MGDPKKKRKVIDYPYDVPDYAIDIADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPAVVTFHKLKLACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 502 - protein, 1049 aa, Artificial sequence
  synthetic polypeptide: pCLS9600
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESGDPSGGSGSMAGYGAKGIRKVGAFRSGLEDKVSKQLESKGIKFEYEEWKVPYVIPASNHTYTPDFLLPNGIFVETKGLWESDDRKKHLLIREQHPELDIRIVFSSSRTKLYKGSPTSYGEFCEKHGIKFADKLIPAEWIKEPKKEVPFDRLKRKGGKKAAD

SEQ ID NO: 503 - protein, 1065 aa, Artificial sequence
  synthetic polypeptide: pCLS9601
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSGSGSGGDPSGGSGSMAGYGAKGIRKVGAFRSGLEDKVSKQLESKGIKFEYEEWKVPYVIPASNHTYTPDFLLPNGIFVETKGLWESDDRKKHLLIREQHPELDIRIVFSSSRTKLYKGSPTSYGEFCEKHGIKFADKLIPAEWIKEPKKEVPFDRLKRKGGKKAAD

SEQ ID NO: 504 - protein, 1076 aa, Artificial sequence
  synthetic polypeptide: pCLS9602
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGDPSGGSGSMAGYGAKGIRKVGAFRSGLEDKVSKQLESKGIKFEYEEWKVPYVIPASNHTYTPDFLLPNGIFVETKGLWESDDRKKHLLIREQHPELDIRIVFSSSRTKLYKGSPTSYGEFCEKHGIKFADKLIPAEWIKEPKKEVPFDRLKRKGGKKAAD

SEQ ID NO: 505 - protein, 1088 aa, Artificial sequence
  synthetic polypeptide: pCLS9603
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLGDPSGGSGSMAGYGAKGIRKVGAFRSGLEDKVSKQLESKGIKFEYEEWKVPYVIPASNHTYTPDFLLPNGIFVETKGLWESDDRKKHLLIREQHPELDIRIVFSSSRTKLYKGSPTSYGEFCEKHGIKFADKLIPAEWIKEPKKEVPFDRLKRKGGKKAAD

SEQ ID NO: 506 - protein, 1112 aa, Artificial sequence
  synthetic polypeptide: pCLS9604
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPALAALTNDHLVALACLGGRPALDAVKKGLPHAPALIKRTNRRIPERTSHRVADGDPSGGSGSMAGYGAKGIRKVGAFRSGLEDKVSKQLESKGIKFEYEEWKVPYVIPASNHTYTPDFLLPNGIFVETKGLWESDDRKKHLLIREQHPELDIRIVFSSSRTKLYKGSPTSYGEFCEKHGIKFADKLIPAEWIKEPKKEVPFDRLKRKGGKKAAD

SEQ ID NO: 507 - DNA, 3201 bp, Artificial sequence
  synthetic polynucleotide: pCLS10004
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 508 - DNA, 3201 bp, Artificial sequence
  synthetic polynucleotide: pCLS11395
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 509 - DNA, 3201 bp, Artificial sequence
  synthetic polynucleotide: pCLS11394
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 510 - DNA, 3201 bp, Artificial sequence
  synthetic polynucleotide: pCLS11392
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 511 - DNA, 3201 bp, Artificial sequence
  synthetic polynucleotide: pCLS11393
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 512 - DNA, 3201 bp, Artificial sequence
  synthetic polynucleotide: pCLS11388
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 513 - DNA, 3201 bp, Artificial sequence
  synthetic polynucleotide: pCLS11389
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 514 - DNA, 3201 bp, Artificial sequence
  synthetic polynucleotide: pCLS11390
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 515 - DNA, 3201 bp, Artificial sequence
  synthetic polynucleotide: pCLS11391
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 516 - DNA, 3201 bp, Artificial sequence
  synthetic polynucleotide: pCLS12940
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 517 - DNA, 3201 bp, Artificial sequence
  synthetic polynucleotide: pCLS13139
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 518 - DNA, 3201 bp, Artificial sequence
  synthetic polynucleotide: pCLS8254
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 519 - DNA, 3201 bp, Artificial sequence
  synthetic polynucleotide: pCLS8258
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 520 - DNA, 3201 bp, Artificial sequence
  synthetic polynucleotide: pCLS8168
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 521 - DNA, 3201 bp, Artificial sequence
  synthetic polynucleotide: pCLS7996
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 522 - DNA, 3201 bp, Artificial sequence
  synthetic polynucleotide: pCLS8008
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 523 - DNA, 3201 bp, Artificial sequence
  synthetic polynucleotide: pCLS8010
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 524 - DNA, 2997 bp, Artificial sequence
  synthetic polynucleotide: pCLS10003
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 525 - DNA, 2997 bp, Artificial sequence
  synthetic polynucleotide: pCLS10293
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 526 - DNA, 2997 bp, Artificial sequence
  pCLS10292
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 527 - DNA, 2997 bp, Artificial sequence
  synthetic polynucleotide: pCLS10296
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 528 - DNA, 2997 bp, Artificial sequence
  synthetic polynucleotide: pCLS9999
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 529 - DNA, 2997 bp, Artificial sequence
  synthetic polynucleotide: pCLS10338
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 530 - DNA, 2997 bp, Artificial sequence
  synthetic polynucleotide: pCLS8707
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 531 - DNA, 2997 bp, Artificial sequence
  synthetic polynucleotide: pCLS8713
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 532 - DNA, 2895 bp, Artificial sequence
  synthetic polynucleotide: pCLS10284
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 533 - DNA, 2895 bp, Artificial sequence
  synthetic polynucleotide: pCLS10294
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 534 - DNA, 2895 bp, Artificial sequence
  synthetic polynucleotide: pCLS10295
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 535 - DNA, 2895 bp, Artificial sequence
  synthetic polynucleotide: pCLS10285
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 536 - DNA, 2895 bp, Artificial sequence
  synthetic polynucleotide: pCLS10283
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 537 - DNA, 2895 bp, Artificial sequence
  synthetic polynucleotide: pCLS10286
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 538 - DNA, 2895 bp, Artificial sequence
  synthetic polynucleotide: pCLS10386
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 539 - DNA, 2793 bp, Artificial sequence
  synthetic polynucleotide: pCLS10002
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 540 - DNA, 2793 bp, Artificial sequence
  synthetic polynucleotide: pCLS10287
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 541 - DNA, 2793 bp, Artificial sequence
  synthetic polynucleotide: pCLS10298
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 542 - DNA, 2793 bp, Artificial sequence
  synthetic polynucleotide: pCLS8708
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 543 - DNA, 2793 bp, Artificial sequence
  synthetic polynucleotide: pCLS8714
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 544 - DNA, 2691 bp, Artificial sequence
  synthetic polynucleotide: pCLS10289
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 545 - DNA, 2691 bp, Artificial sequence
  synthetic polynucleotide: pCLS10301
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 546 - DNA, 2589 bp, Artificial sequence
  synthetic polynucleotide: pCLS10290
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 547 - DNA, 2589 bp, Artificial sequence
  synthetic polynucleotide: pCLS10303
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 548 - DNA, 2589 bp, Artificial sequence
  synthetic polynucleotide: pCLS10291
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 549 - DNA, 2589 bp, Artificial sequence
  synthetic polynucleotide: pCLS10304
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 550 - DNA, 2589 bp, Artificial sequence
  synthetic polynucleotide: pCLS10302
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 551 - DNA, 2589 bp, Artificial sequence
  synthetic polynucleotide: pCLS8709
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 552 - DNA, 2589 bp, Artificial sequence
  synthetic polynucleotide: pCLS8715
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 553 - DNA, 2997 bp, Artificial sequence
  synthetic polynucleotide: pCLS14520
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 554 - DNA, 2997 bp, Artificial sequence
  synthetic polynucleotide: pCLS14518
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 555 - DNA, 2793 bp, Artificial sequence
  synthetic polynucleotide: pCLS14519
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 556 - DNA, 2793 bp, Artificial sequence
  synthetic polynucleotide: pCLS14521
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 557 - DNA, 2589 bp, Artificial sequence
  synthetic polynucleotide: pCLS14516
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 558 - DNA, 2589 bp, Artificial sequence
  synthetic polynucleotide: pCLS14517
atggccgaccccattcgttcgcgcacaccaagtcctgcccgcgagcttctgcccggaccccaacccgatggggttcagccgactgcagatcgtggggtgtctccgcctgccggcggccccctggatggcttgccggctcggcggacgatgtcccggacccggctgccatctccccctgccccctcacctgcgttctcggcgggcagcttcagtgacctgttacgtcagttcgatccgtcactttttaatacatcgctttttgattcattgcctcccttcggcgctcaccatacagaggctgccacaggcgagtgggatgaggtgcaatcgggtctgcgggcagccgacgcccccccacccaccatgcgcgtggctgtcactgccgcgcggcccccgcgcgccaagccggcgccgcgacgacgtgctgcgcaaccctccgacgcttcgccggcggcgcaggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccggcgttggccgcgttgaccaacgaccacctcgtcgccttggcctgcctcggcgggcgtcctgcgctggatgcagtgaaaaagggattgggggatcctatcagccgttcccagctggtgaagtccgagctggaggagaagaaatccgagttgaggcacaagctgaagtacgtgccccacgagtacatcgagctgatcgagatcgcccggaacagcacccaggaccgtatcctggagatgaaggtgatggagttcttcatgaaggtgtacggctacaggggcaagcacctgggcggctccaggaagcccgacggcgccatctacaccgtgggctcccccatcgactacggcgtgatcgtggacaccaaggcctactccggcggctacaacctgcccatcggccaggccgacgaaatgcagaggtacgtggaggagaaccagaccaggaacaagcacatcaaccccaacgagtggtggaaggtgtacccctccagcgtgaccgagttcaagttcctgttcgtgtccggccacttcaagggcaactacaaggcccagctgaccaggctgaaccacatcaccaactgcaacggcgccgtgctgtccgtggaggagctcctgatcggcggcgagatgatcaaggccggcaccctgaccctggaggaggtgaggaggaagttcaacaacggcgagatcaacttcgcggccgactgataa

SEQ ID NO: 559 - DNA, 49 bp, Artificial sequence
  synthetic polynucleotide: FUT8_T1.3
ttctagcagagaactctccaagattcttgcaaagagttctctgctagaa

SEQ ID NO: 560 - DNA, 49 bp, Artificial sequence
  synthetic polynucleotide: FUT8_T1.4
ttttaagcgctccagctccaagattcttgcaaagctggagcgcttaaaa

SEQ ID NO: 561 - DNA, 49 bp, Artificial sequence
  synthetic polynucleotide: FUT8_T3.4
ttctgagattccaagatacccagcgaacactcatcttggaatctcagaa

SEQ ID NO: 562 - DNA, 49 bp, Artificial sequence
  synthetic polynucleotide: FUT8_T3.3
tcatgattgcttatggcacccagcgaacactcgccataagcaatcatga

SEQ ID NO: 563 - DNA, 49 bp, Artificial sequence
  synthetic polynucleotide: BAK_T3.4
ttaatgtcatctccaatcggcagcttgctatcattggagatgacattaa

SEQ ID NO: 564 - DNA, 49 bp, Artificial sequence
  synthetic polynucleotide: BAK_T3.3
tcttgggtcaggtgggccggcagcttgctatcgcccacctgacccaaga

SEQ ID NO: 565 - DNA, 49 bp, Artificial sequence
  synthetic polynucleotide: BAK_T4.4
tgtaccacgtactggccggtgtggttctgttgggccagtacgtggtaca

SEQ ID NO: 566 - DNA, 49 bp, Artificial sequence
  synthetic polynucleotide: BAK_T4.3
ttgtgatgacaattcttggtgtggttctgttgaagaattgtcatcacaa

SEQ ID NO: 567 - DNA, 49 bp, Artificial sequence
  synthetic polynucleotide: BAX_T3.3
taattattgggaggggtgggaatggtggccctacccctcccaataatta

SEQ ID NO: 568 - DNA, 49 bp, Artificial sequence
  synthetic polynucleotide: BAX_T3.4
ttattgtcccctcccccgggaatggtggccctgggggaggggacaataa

SEQ ID NO: 569 - DNA, 49 bp, Artificial sequence; identical to SEQ ID NO: 210
  synthetic polynucleotide: SH6T1.3

SEQ ID NO: 570 - DNA, 49 bp, Artificial sequence; identical to SEQ ID NO: 205
  synthetic polynucleotide: SH6T1.4

SEQ ID NO: 571 - DNA, 49 bp, Artificial sequence; identical to SEQ ID NO: 206
  synthetic polynucleotide: DMDT2.3

SEQ ID NO: 572 - DNA, 49 bp, Artificial sequence; identical to SEQ ID NO: 214
  synthetic polynucleotide: RAGT2.3

SEQ ID NO: 573 - DNA, 49 bp, Artificial sequence; identical to SEQ ID NO: 213
  synthetic polynucleotide: RAGT2.4

SEQ ID NO: 574 - DNA, 49 bp, Artificial sequence
  synthetic polynucleotide: FUT8_2.3
tctatactacctcagtcaaacagatggagcaggactgaggtagtataga

SEQ ID NO: 575 - DNA, 49 bp, Artificial sequence; identical to SEQ ID NO: 560
  synthetic polynucleotide: FUT8_T1.4

SEQ ID NO: 576 - DNA, 45 bp, Artificial sequence
  synthetic polynucleotide: RAGT2.4_14bp
tgtttatggttacttatgtgtgtaacaggtaagtaaccataaaca

SEQ ID NO: 577 - DNA, 41 bp, Artificial sequence
  synthetic polynucleotide: RAGT2.4_12bp
tgtttatggttacatgtgtgtaacaggtgtaaccataaaca

SEQ ID NO: 578 - DNA, 37 bp, Artificial sequence
  synthetic polynucleotide: RAGT2.4_10bp
tgtttatggttatgtgtgtaacaggtaaccataaaca

SEQ ID NO: 579 - DNA, 45 bp, Artificial sequence
  synthetic polynucleotide: DMDT2.3_14bp
tgtattcctttatggcagttaacattataaccataaaggaataca

SEQ ID NO: 580 - DNA, 41 bp, Artificial sequence
  synthetic polynucleotide: DMDT2.3_12bp
tgtattcctttatcagttaacattataaataaaggaataca

SEQ ID NO: 581 - DNA, 37 bp, Artificial sequence
  synthetic polynucleotide: DMDT2.3_10bp
tgtattcctttcagttaacattataaaaaggaataca

SEQ ID NO: 582 - DNA, 1590 bp, Artificial sequence; identical to SEQ ID NO: 494
  synthetic polynucleotide: RAGT2.3 TAL repeat array

SEQ ID NO: 583 - protein, 528 aa, Artificial sequence
  synthetic polypeptide: RAGT2.3 TAL repeat array
LTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPQQVVAIASNNGGKQALETVQRLLPLCQAHGLTPEQVVAIASHDGGKQALETVQRLLPVLCQAHGLTPEQVVAIASNIGGKQALETVQALLPVLCQAHGLPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALE

SEQ ID NO: 584 - DNA, 170 bp, Artificial sequence
  synthetic polynucleotide: TALE Repeat NI
ggccggacgggccgacgtccgcagcgacatgttgaccccggagcaggtggtggccatcgccagcaatattggtggcaagcaggcgctggagacggtgcaggcgctgttgccggtgctgtgccaggcccacggcttgaccctcgagatgcggtaccggggccactggggcc

SEQ ID NO: 585 - protein, 34 aa, Artificial sequence
  synthetic polypeptide: TALE Repeat NI
LTPEQVVAIASNIGGKQALETVQALLPVLCQAHG

SEQ ID NO: 586 - DNA, 170 bp, Artificial sequence
  synthetic polynucleotide: TALE Repeat NG
ggccggacgggccgacgtccgcagcgacatgttgaccccccagcaggtggtggccatcgccagcaatggcggtggcaagcaggcgctggagacggtccagcggctgttgccggtgctgtgccaggcccacggcttgaccctcgagatgcggtaccggggccactggggcc

SEQ ID NO: 587 - protein, 34 aa, Artificial sequence
  synthetic polypeptide: TALE Repeat NG
LTPQQVVAIASNGGGKQALETVQRLLPVLCQAHG

SEQ ID NO: 588 - DNA, 170 bp, Artificial sequence
  synthetic polynucleotide: TALE Repeat HD
ggccggacgggccgacgtccgcagcgacatgttgaccccggagcaggtggtggccatcgccagccacgatggcggcaagcaggcgctggagacggtccagcggctgttgccggtgctgtgccaggcccacggcttgaccctcgagatgcggtaccggggccactggggcc

SEQ ID NO: 589 - DNA, 170 bp, Artificial sequence; identical to SEQ ID NO: 584
  synthetic polynucleotide: TALE Repeat NI

SEQ ID NO: 590 - DNA, 170 bp, Artificial sequence
  synthetic polynucleotide: TALE Repeat NN
ggccggacgggccgacgtccgcagcgacatgttgaccccccagcaggtggtggccatcgccagcaataatggtggcaagcaggcgctggagacggtccagcggctgttgccggtgctgtgccaggcccacggcttgaccctcgagatgcggtaccggggccactggggcc

SEQ ID NO: 591 - DNA, 170 bp, Artificial sequence; identical to SEQ ID NO: 586
  synthetic polynucleotide: TALE Repeat NG

SEQ ID NO: 592 - protein, 34 aa, Artificial sequence
  synthetic polypeptide TALE Repeat HD
LTPEQVVAIASHDGGKQALETVQRLLPVLCQAHG

SEQ ID NO: 593 - protein, 34 aa, Artificial sequence; identical to SEQ ID NO: 585
  synthetic polypeptide: TALE Repeat NI

SEQ ID NO: 594 - protein, 34 aa, Artificial sequence
  synthetic polypeptide: TALE Repeat NN
LTPQQVVAIASNNGGKQALETVQRLLPVLCQAHG

SEQ ID NO: 595 - protein, 34 aa, Artificial sequence; identical to SEQ ID NO: 587
  synthetic polypeptide: TALE Repeat NG

SEQ ID NO: 596 - protein, 1653 aa, Artificial sequence
  synthetic polynucleotide: pCLS7808
ATGGCCGACCCCATTCGTTCGCGCACACCAAGTCCTGCCCGCGAGCTTCTGCCCGGACCCCAACCCGATGGGGTTCAGCCGACTGCAGATCGTGGGGTGTCTCCGCCTGCCGGCGGCCCCCTGGATGGCTTGCCGGCTCGGCGGACGATGTCCCGGACCCGGCTGCCATCTCCCCCTGCCCCCTCACCTGCGTTCTCGGCGGGCAGCTTCAGTGACCTGTTACGTCAGTTCGATCCGTCACTTTTTAATACATCGCTTTTTGATTCATTGCCTCCCTTCGGCGCTCACCATACAGAGGCTGCCACAGGCGAGTGGGATGAGGTGCAATCGGGTCTGCGGGCAGCCGACGCCCCCCCACCCACCATGCGCGTGGCTGTCACTGCCGCGCGGCCCCCGCGCGCCAAGCCGGCGCCGCGACGACGTGCTGCGCAACCCTCCGACGCTTCGCCGGCGGCGCAGGTGGATCTACGCACGCTCGGCTACAGCCAGCAGCAACAGGAGAAGATCAAACCGAAGGTTCGTTCGACAGTGGCGCAGCACCACGAGGCACTGGTCGGCCACGGGTTTACACACGCGCACATCGTTGCGTTAAGCCAACACCCGGCAGCGTTAGGGACCGTCGCTGTCAAGTATCAGGACATGATCGCAGCGTTGCCAGAGGCGACACACGAAGCGATCGTTGGCGTCGGCAAACAGTGGTCCGGCGCACGCGCTCTGGAGGCCTTGCTCACGGTGGCGGGAGAGTTGAGAGGTCCACCGTTACAGTTGGACACAGGCCAACTTCTCAAGATTGCAAAACGTGGCGGCGTGACCGCAGTGGAGGCAGTGCATGCATGGCGCAATGCACTGACGGGTGCCCCGCTCAACTTGACCGGAGACGCCCGGGGGATCAGGTCACGTGCGTCTCGGAGCATTGTTGCCCAGTTATCTCGCCCTGATCCGGCGTTGGCCGCGTTGACCAACGACCACCTCGTCGCCTTGGCCTGCCTCGGCGGGCGTCCTGCGCTGGATGCAGTGAAAAAGGGATTGGGGGATCCTATCAGCCGTTCCCAGCTGGTGAAGTCCGAGCTGGAGGAGAAGAAATCCGAGTTGAGGCACAAGCTGAAGTACGTGCCCCACGAGTACATCGAGCTGATCGAGATCGCCCGGAACAGCACCCAGGACCGTATCCTGGAGATGAAGGTGATGGAGTTCTTCATGAAGGTGTACGGCTACAGGGGCAAGCACCTGGGCGGCTCCAGGAAGCCCGACGGCGCCATCTACACCGTGGGCTCCCCCATCGACTACGGCGTGATCGTGGACACCAAGGCCTACTCCGGCGGCTACAACCTGCCCATCGGCCAGGCCGACGAAATGCAGAGGTACGTGGAGGAGAACCAGACCAGGAACAAGCACATCAACCCCAACGAGTGGTGGAAGGTGTACCCCTCCAGCGTGACCGAGTTCAAGTTCCTGTTCGTGTCCGGCCACTTCAAGGGCAACTACAAGGCCCAGCTGACCAGGCTGAACCACATCACCAACTGCAACGGCGCCGTGCTGTCCGTGGAGGAGCTCCTGATCGGCGGCGAGATGATCAAGGCCGGCACCCTGACCCTGGAGGAGGTGAGGAGGAAGTTCAACAACGGCGAGATCAACTTCGCGGCCGACTGATAA

SEQ ID NO: 597 - protein, 549 aa, Artificial sequence
  synthetic polypeptide: pCLS7808
MADPIRSRTPSPARELLPGPQPDGVQPTADRGVSPPAGGPLDGLPARRTMSRTRLPSPPAPSPAFSAGSFSDLLRQFDPSLFNTSLFDSLPPFGAHHTEAATGEWDEVQSGLRAADAPPPTMRVAVTAARPPRAKPAPRRRAAQPSDASPAAQVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPALAALTNDHLVALACLGGRPALDAVKKGLGDPISRSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFAAD

SEQ ID NO: 598 - protein, 582 aa, Artificial sequence
  synthetic polynucleotide: Colicin-E9
MSGGDGRGHNTGAHSTSGNINGGPTGIGVSGGASDGSGWSSENNPWGGGSGSGIHWGGGSGRGNGGGNGNSGGGSGTGGNLSAVAAPVAFGFPALSTPGAGGLAVSISASELSAAIAGIIAKLKKVNLKFTPFGVVLSSLIPSEIAKDDPNMMSKIVTSLPADDITESPVSSLPLDKATVNVNVRVVDDVKDERQNISVVSGVPMSVPVVDAKPTERPGVFTASIPGAPVLNISVNDSTPAVQTLSPGVTNNTDKDVRPAGFTQGGNTRDAVIRFPKDSGHNAVYVSVSDVLSPDQVKQRQDEENRRQQEWDATHPVEAAERNYERARAELNQANEDVARNQERQAKAVQVYNSRKSELDAANKTLADAIAEIKQFNRFAHDPMAGGHRMWQMAGLKAQRAQTDVNNKQAAFDAAAKEKSDADAALSAAQERRKQKENKEKDAKDKLDKESKRNKPGKATGKGKPVGDKWLDDAGKDSGAPIPDRIADKLRDKEFKSFDDFRKAVWEEVSKDPELSKNLNPSNKSSVSKGYSPFTPKNQQVGGRKVYELHHDKPISQGGEVYDMDNIRVTTPKRHIDIHRGK

SEQ ID NO: 599 - protein, 511 aa, Artificial sequence
  synthetic polypeptide: APFL
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWEPGKEDEEKEDVEELLKEAKRFMKRK

SEQ ID NO: 600 - protein, 583 aa, Artificial sequence
  synthetic polypeptide: FokI wild-type
MFLSMVSKIRTFGWVQNPGKFENLKRVVQVFDRNSKVHNEVKNIKIPTLVKESKIQKELVAIMNQHDLIYTYKELVGTGTSIRSEAPCDAIIQATIADQGNKKGYIDNWSSDGFLRWAHALGFIEYINKSDSFVITDVGLAYSKSADGSAIEKEILIEAISSYPPAIRILTLLEDGQHLTKFDLGKNLGFSGESGFTSLPEGILLDTLANAMPKDKGEIRNNWEGSSDKYARMIGGWLDKLGLVKQGKKEFIIPTLGKPDNKEFISHAFKITGEGLKVLRRAKGSTKFTRVPKRVYWEMLATNLTDKEYVRTRRALILEILIKAGSLKIEQIQDNLKKLGFDEVIETIENDIKGLINTGIFIEIKGRFYQLKDHILQFVIPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINF

SEQ ID NO: 601 - DNA, 49 bp, Artificial sequence; identical to SEQ ID NO: 213
  synthetic polynucleotide: RAGT2.4 TALEN target

SEQ ID NO: 602 - DNA, 49 bp, Artificial sequence
  synthetic polynucelotide: RAGT2L_DT1
tatatttaagcacttagatgtgtgtaacaggtctaagtgcttaaatata

SEQ ID NO: 603 - DNA, 49 bp, Artificial sequence
  synthetic polynucelotide: RAGT2L_DT12
tatatttaagcacttctatgtgtgtaacaggtagaagtgcttaaatata

SEQ ID NO: 604 - DNA, 49 bp, Artificial sequence
  synthetic polynucelotide: RAGT2L_DT3
tatatttaagcacttaaatgtgtgtaacaggtttaagtgcttaaatata

SEQ ID NO: 605 - DNA, 49 bp, Artificial sequence
  synthetic polynucelotide: RAGT2L_DT4
tatatttaagcacttttatgtgtgtaacaggtaaaagtgcttaaatata

SEQ ID NO: 606 - DNA, 49 bp, Artificial sequence
  synthetic polynucelotide: RAGT2L_DT2
tatatttaagcacttacatgtgtgtaacaggtgtaagtgcttaaatata

SEQ ID NO: 607 - DNA, 49 bp, Artificial sequence
  synthetic polynucelotide: RAGT2L_DT8
tatatttaagcacttgtatgtgtgtaacaggtacaagtgcttaaatata

SEQ ID NO: 608 - DNA, 49 bp, Artificial sequence
  RAGT2L_DT9
tatatttaagcacttggatgtgtgtaacaggtccaagtgcttaaatata

SEQ ID NO: 609 - DNA, 49 bp, Artificial sequence
  synthetic polynucelotide: RAGT2R_DT1
tgtttatggttacttagatgtgtgtaacaggtctaagtaaccataaaca

SEQ ID NO: 610 - DNA, 49 bp, Artificial sequence
  synthetic polynucelotide: RAGT2R_DT12
tgtttatggttacttctatgtgtgtaacaggtagaagtaaccataaaca

SEQ ID NO: 611 - DNA, 49 bp, Artificial sequence
  synthetic polynucelotide: RAGT2R_DT2
tgtttatggttacttacatgtgtgtaacaggtgtaagtaaccataaaca

SEQ ID NO: 612 - DNA, 49 bp, Artificial sequence
  synthetic polynucelotide: RAGT2R_DT3
tgtttatggttacttaaatgtgtgtaacaggtttaagtaaccataaaca

SEQ ID NO: 613 - DNA, 49 bp, Artificial sequence
  synthetic polynucelotide: RAGT2R_DT4
tgtttatggttacttttatgtgtgtaacaggtaaaagtaaccataaaca

SEQ ID NO: 614 - DNA, 49 bp, Artificial sequence
  synthetic polynucelotide: RAGT2R_DT8
tgtttatggttacttgtatgtgtgtaacaggtacaagtaaccataaaca

SEQ ID NO: 615 - DNA, 49 bp, Artificial sequence
  synthetic polynucelotide: RAGT2R_DT9
tgtttatggttacttggatgtgtgtaacaggtccaagtaaccataaaca

SEQ ID NO: 616 - DNA, 3201 bp, Artificial sequence; identical to SEQ ID NO: 522
  synthetic polynucelotide: RAGT2.3_15.5b

SEQ ID NO: 617 - DNA, 3201 bp, Artificial sequence; identical to SEQ ID NO: 523
  synthetic polynucelotide: RAGT2.4_15.5b

SEQ ID NO: 618 - DNA, 2997 bp, Artificial sequence; identical to SEQ ID NO: 530
  synthetic polynucelotide: RAGT2.3_13,5bl

SEQ ID NO: 619 - DNA, 2793 bp, Artificial sequence; identical to SEQ ID NO: 542
  synthetic polynucelotide: RAGT2.3_11.5bl

SEQ ID NO: 620 - DNA, 2589 bp, Artificial sequence; identical to SEQ ID NO: 551
  synthetic polynucelotide: RAGT2.3_9.5bl

SEQ ID NO: 621 - DNA, 2997 bp, Artificial sequence; identical to SEQ ID NO: 531
  synthetic polynucelotide: RAGT2.4_13.5b

SEQ ID NO: 622 - DNA, 2793 bp, Artificial sequence; identical to SEQ ID NO: 543
  synthetic polynucelotide: RAGT2.4_11.5bl

SEQ ID NO: 623 - DNA, 2589 bp, Artificial sequence; identical to SEQ ID NO: 552
  synthetic polynucelotide: RAGT2.4_9.5bl

SEQ ID NO: 624 - protein, 173 aa, Artificial sequence
  synthetic polypeptide: pCLS9008
MANTGGSSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPSAD

SEQ ID NO: 625 - protein, 375 aa, Artificial sequence
  synthetic polypeptide: FokI-L_cT11
MASGPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFGSSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPSAD

SEQ ID NO: 626 - protein, 598 aa, Artificial sequence; identical to SEQ ID NO: 4
  synthetic polypeptide: RVDs AvrBs3

SEQ ID NO: 627 - protein, 959 aa, Artificial sequence
  synthetic polypeptide: FokI-L_cT11Avr
MASGPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFGSSGVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGRPALESIVAQLSRPDPSAD

SEQ ID NO: 628 - DNA, 11178 bp, Artificial sequence
  synthetic polynucleotide: pCLS8674
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggcatccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctccggagtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagccacgatggcggcaagcaggcgctggagacggtccagcggctgttgccggtgctgtgccaggcccacggcttgacccctcagcaggtggtggccatcgccagcaatggcggcggcaggccggcgctggagagcattgttgcccagttatctcgccctgatccgtcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctattacattatgggtggtatgttggaataaaaatcaactatcatctactaactagtatttacgttactagtatattatcatatacggtgttagaagatgacgcaaatgatgagaaatagtcatctaaattagtggaagctgaaacgcaaggattgataatgtaataggatcaatgaatattaacatataaaatgatgataataatatttatagaattgtgtagaattgcagattcccttttatggattcctaaatcctcgaggagaacttctagtatatctacatacctaatattattgccttattaaaaatggaatcccaacaattacatcaaaatccacattctcttcaaaatcaattgtcctgtacttccttgttcatgtgtgttcaaaaacgttatatttataggataattatactctatttctcaacaagtaattggttgtttggccgagcggtctaaggcgcctgattcaagaaatatcttgaccgcagttaactgtgggaatactcaggtatcgtaagatgcaagagttcgaatctcttagcaaccattatttttttcctcaacataacgagaacacacaggggcgctatcgcacagaatcaaattcgatgactggaaattttttgttaatttcagaggtcgcctgacgcatatacctttttcaactgaaaaattgggagaaaaaggaaaggtgagagccgcggaaccggcttttcatatagaatagagaagcgttcatgactaaatgcttgcatcacaatacttgaagttgacaatattatttaaggacctattgttttttccaataggtggttagcaatcgtcttactttctaacttttcttaccttttacatttcagcaatatatatatatatatttcaaggatataccattctaatgtctgcccctaagaagatcgtcgttttgccaggtgaccacgttggtcaagaaatcacagccgaagccattaaggttcttaaagctatttctgatgttcgttccaatgtcaagttcgatttcgaaaatcatttaattggtggtgctgctatcgatgctacaggtgtcccacttccagatgaggcgctggaagcctccaagaaggttgatgccgttttgttaggtgctgtgggtggtcctaaatggggtaccggtagtgttagacctgaacaaggtttactaaaaatccgtaaagaacttcaattgtacgccaacttaagaccatgtaactttgcatccgactctcttttagacttatctccaatcaagccacaatttgctaaaggtactgacttcgttgttgtcagagaattagtgggaggtatttactttggtaagagaaaggaagacgatggtgatggtgtcgcttgggatagtgaacaatacaccgttccagaagtgcaaagaatcacaagaatggccgctttcatggccctacaacatgagccaccattgcctatttggtccttggataaagctaatgttttggcctcttcaagattatggagaaaaactgtggaggaaaccatcaagaacgaattccctacattgaaggttcaacatcaattgattgattctgccgccatgatcctagttaagaacccaacccacctaaatggtattataatcaccagcaacatgtttggtgatatcatctccgatgaagcctccgttatcccaggttccttgggtttgttgccatctgcgtccttggcctctttgccagacaagaacaccgcatttggtttgtacgaaccatgccacggttctgctccagatttgccaaagaataaggtcaaccctatcgccactatcttgtctgctgcaatgatgttgaaattgtcattgaacttgcctgaagaaggtaaggccattgaagatgcagttaaaaaggttttggatgcaggtatcagaactggtgatttaggtggttccaacagtaccacggaagtcggtgatgctgtcgccgaagaagttaagaaaatccttgcttaaaaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttcccataatggtgaaagttccctcaagaattttactctgtcagaaacggccttaacgacgtagtcgacctcctcttcagtactaaatctaccaataccaaatctgatggaagaatgggctaatgcatcatccttacccagcgcatgtaaaacataagaaggttctagggaagcagatgtacaggctgaacccgaggataatgcgatatcccttagtgccatcaataaagattctccttccacgtaggcgaaagaaacgttaacacaccctggataacgatgatctggagatccgttcaacgtggtatgttcagcggataatagacctttgactaatttatcggatagtcttttgatgtgagcttggtcgttgtcaaattctttcttcatcaatctcgcagcttcaccaaatcccgctaccaatgggggggccaaagtaccagatctgctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 629 - DNA, 43 bp, Artificial sequence
  synthetic polynucleotide: NfusAvr05
agagggttaggtttatataaggtatatataaacctaaccctct

SEQ ID NO: 630 - DNA, 44 bp, Artificial sequence
  synthetic polynucleotide: NfusAvr06
agagggttaggtttatataaaggtatatataaacctaaccctct

SEQ ID NO: 631 - DNA, 45 bp, Artificial sequence
  synthetic polynucleotide: NfusAvr07
agagggttaggtttatataaaggtactatataaacctaaccctct

SEQ ID NO: 632 - DNA, 46 bp, Artificial sequence
  synthetic polynucleotide: NfusAvr08
agagggttaggtttatatagaaggtactatataaacctaaccctct

SEQ ID NO: 633 - DNA, 47 bp, Artificial sequence
  synthetic polynucleotide: NfusAvr09
agagggttaggtttatatagaaggtacctatataaacctaaccctct

SEQ ID NO: 634 - DNA, 48 bp, Artificial sequence
  synthetic polynucleotide: NfusAvr10
agagggttaggtttatatatgaaggtacctatataaacctaaccctct

SEQ ID NO: 635 - DNA, 49 bp, Artificial sequence
  synthetic polynucleotide: NfusAvr11
agagggttaggtttatatatgaaggtaccttatataaacctaaccctct

SEQ ID NO: 636 - DNA, 50 bp, Artificial sequence
  synthetic polynucleotide: NfusAvr12
agagggttaggtttatataatgaaggtaccttatataaacctaaccctct

SEQ ID NO: 637 - DNA, 51 bp, Artificial sequence
  synthetic polynucleotide: NfusAvr13
agagggttaggtttatataatgaaggtacctttatataaacctaaccctct

SEQ ID NO: 638 - DNA, 52 bp, Artificial sequence
  synthetic polynucleotide: NfusAvr14
agagggttaggtttatatacatgaaggtacctttatataaacctaaccctct

SEQ ID NO: 639 - DNA, 53 bp, Artificial sequence
  synthetic polynucleotide: NfusAvr15
agagggttaggtttatatacatgaaggtaccttgtatataaacctaaccctct

SEQ ID NO: 640 - DNA, 54 bp, Artificial sequence
  synthetic polynucleotide: NfusAvr16
agagggttaggtttatatagcatgaaggtaccttgtatataaacctaaccctct

SEQ ID NO: 641 - DNA, 55 bp, Artificial sequence
  synthetic polynucleotide: NfusAvr17
agagggttaggtttatatagcatgaaggtaccttgttatataaacctaaccctct

SEQ ID NO: 642 - DNA, 56 bp, Artificial sequence
  synthetic polynucleotide: NfusAvr18
agagggttaggtttatataagcatgaaggtaccttgttatataaacctaaccctct

SEQ ID NO: 643 - DNA, 57 bp, Artificial sequence
  synthetic polynucleotide: NfusAvr19
agagggttaggtttatataagcatgaaggtaccttgtctatataaacctaaccctct

SEQ ID NO: 644 - DNA, 58 bp, Artificial sequence
  synthetic polynucleotide: NfusAvr20
agagggttaggtttatatatagcatgaaggtaccttgtctatataaacctaaccctct

SEQ ID NO: 645 - DNA, 59 bp, Artificial sequence
  synthetic polynucleotide: NfusAvr21
agagggttaggtttatatatagcatgaaggtaccttgtcgtatataaacctaaccctct

SEQ ID NO: 646 - DNA, 60 bp, Artificial sequence
  synthetic polynucleotide: NfusAvr22
agagggttaggtttatatatagcatgaaggtaccttgtcgttatataaacctaaccctct

SEQ ID NO: 647 - DNA, 61 bp, Artificial sequence
  synthetic polynucleotide: NfusAvr23
agagggttaggtttatatactagcatgaaggtaccttgtcgttatataaacctaaccctct

SEQ ID NO: 648 - DNA, 62 bp, Artificial sequence
  synthetic polynucleotide: NfusAvr24
agagggttaggtttatatactagcatgaaggtaccttgtcgtttatataaacctaaccctct

SEQ ID NO: 649 - DNA, 63 bp, Artificial sequence
  synthetic polynucleotide: NfusAvr25
agagggttaggtttatataactagcatgaaggtaccttgtcgtttatataaacctaaccctct

SEQ ID NO: 650 - DNA, 64 bp, Artificial sequence
  synthetic polynucleotide: NfusAvr26
agagggttaggtttatataactagcatgaaggtaccttgtcgttgtatataaacctaaccctct

SEQ ID NO: 651 - DNA, 65 bp, Artificial sequence
  synthetic polynucleotide: NfusAvr27
agagggttaggtttatatacactagcatgaaggtaccttgtcgttgtatataaacctaaccctct

SEQ ID NO: 652 - DNA, 66 bp, Artificial sequence
  synthetic polynucleotide: NfusAvr28
agagggttaggtttatatacactagcatgaaggtaccttgtcgttgatatataaacctaaccctct

SEQ ID NO: 653 - DNA, 67 bp, Artificial sequence
  synthetic polynucleotide: NfusAvr29
agagggttaggtttatataccactagcatgaaggtaccttgtcgttgatatataaacctaaccctct

SEQ ID NO: 654 - DNA, 68 bp, Artificial sequence
  synthetic polynucleotide: NfusAvr30
agagggttaggtttatataccactagcatgaaggtaccttgtcgttgattatataaacctaaccctct

SEQ ID NO: 655 - DNA, 69 bp, Artificial sequence
  synthetic polynucleotide: NfusAvr31
agagggttaggtttatataaccactagcatgaaggtaccttgtcgttgattatataaacctaaccctct

SEQ ID NO: 656 - DNA, 70 bp, Artificial sequence
  synthetic polynucleotide: NfusAvr32
agagggttaggtttatataaccactagcatgaaggtaccttgtcgttgatttatataaacctaaccctct

SEQ ID NO: 657 - DNA, 71 bp, Artificial sequence
  synthetic polynucleotide: NfusAvr33
agagggttaggtttatatagaccactagcatgaaggtaccttgtcgttgatttatataaacctaaccctct

SEQ ID NO: 658 - DNA, 72 bp, Artificial sequence
  synthetic polynucleotide: NfusAvr34
agagggttaggtttatatagaccactagcatgaaggtaccttgtcgttgattctatataaacctaaccctct

SEQ ID NO: 659 - DNA, 73 bp, Artificial sequence
  synthetic polynucleotide: NfusAvr35
agagggttaggtttatatatgaccactagcatgaaggtaccttgtcgttgattctatataaacctaaccctct

SEQ ID NO: 660 - protein, 171 aa, Artificial sequence
  synthetic polypeptide: pCLS9009
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSSGRSSAD

SEQ ID NO: 661 - protein, 374 aa, Artificial sequence
  synthetic polypeptide: cT11_FokI-L
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTGDARGIRSRASRSIVAQLSRPDPGSSGPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFGSSAD

SEQ ID NO: 662 - DNA, 1614 bp, Artificial sequence
  synthetic polypeptide: RagT2-R [RVD DNA]
gcagcctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgtgatgc

SEQ ID NO: 663 - protein, 890 aa, Artificial sequence
  synthetic polypeptide: cT11RagT2-R_FokI-L
MVDLRTLGYSQQQQEKIKPKVRSTVAQHHEALVGHGFTHAHIVALSQHPAALGTVAVKYQDMIAALPEATHEAIVGVGKQWSGARALEALLTVAGELRGPPLQLDTGQLLKIAKRGGVTAVEAVHAWRNALTGAPLNLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPQQVVAIASNGGGRPALESIVAQLSRPDPGSSGPNRGVTKQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVEENQTRNKHINPNEWWKVYPSSVTEFKFLFVSGHFKGNYKAQLTRLNHITNCNGAVLSVEELLIGGEMIKAGTLTLEEVRRKFNNGEINFGSSAD

SEQ ID NO: 664 - DNA, 8654 bp, Artificial sequence
  synthetic polynucleotide: pCLS9827
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggtggatctacgcacgctcggctacagccagcagcaacaggagaagatcaaaccgaaggttcgttcgacagtggcgcagcaccacgaggcactggtcggccacgggtttacacacgcgcacatcgttgcgttaagccaacacccggcagcgttagggaccgtcgctgtcaagtatcaggacatgatcgcagcgttgccagaggcgacacacgaagcgatcgttggcgtcggcaaacagtggtccggcgcacgcgctctggaggccttgctcacggtggcgggagagttgagaggtccaccgttacagttggacacaggccaacttctcaagattgcaaaacgtggcggcgtgaccgcagtggaggcagtgcatgcatggcgcaatgcactgacgggtgccccgctcaacttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaataatggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgaccccggagcaggtggtggccatcgccagccacgatggcggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccccagcaggtggtggccatcgccagcaatggcggtggcaagcaggcgctggagacggtccagcggctgttgccggtgctgtgccaggcccacggcttgaccccggagcaggtggtggccatcgccagcaatattggtggcaagcaggcgctggagacggtgcaggcgctgttgccggtgctgtgccaggcccacggcttgacccctcagcaggtggtggccatcgccagcaatggcggcggcaggccggcgctggagagcattgttgcccagttatctcgccctgatccgggatcctccggaccgaacagaggcgttaccaagcaactagttaaatccgaactggaagagaaaaagtccgagttgcgtcataaactgaagtacgttccacatgaatacattgaactgatcgagattgcccgtaacagcacccaggacagaatcctggaaatgaaagtgatggagtttttcatgaaagtgtacggctacagaggcaaacatttgggcggtagccgtaaaccggatggtgccatctacaccgttggcagcccgatcgattacggcgtgatcgttgataccaaagcctactccggtggctacaacctgccgattggccaggctgacgaaatgcagagatacgtggaagagaaccagactcgtaacaagcatatcaacccgaacgaatggtggaaagtctacccgagttccgtgactgagttcaaatttctgtttgtgagcggccatttcaaaggcaactacaaagcccagctgaccagactgaaccatatcaccaactgcaacggtgccgtcttgagcgtggaagaactgttgattggtggcgaaatgatcaaggctggcaccctgactctggaggaagttagacgtaaattcaacaacggtgaaatcaactttggatcctcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgcatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcgaccgcggatctgccggtctccctatagtgagtcgtattaatttcgataagccaggttaacctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 665 - DNA, 6017 bp, Artificial sequence
  synthetic polynucleotide: pCLS7763
atgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagcggatacatatttgaatgtatttagaaaaataaacaaataggggttccgcgcacatttccccgaaaagtgccacctgacgtccgatcaaaaatcatcgcttcgctgattaattaccccagaaataaggctaaaaaactaatcgcattatcatcctatggttgttaatttgattcgttcatttgaaggtttgtggggccaggttactgccaatttttcctcttcataaccataaaagctagtattgtagaatctttattgttcggagcagtgcggcgcgaggcacatctgcgtttcaggaacgcgaccggtgaagacgaggacgcacggaggagagtcttccttcggagggctgtcacccgctcggcggcttctaatccgtacttcaatatagcaatgagcagttaagcgtattactgaaagttccaaagagaaggtttttttaggctaatcgacctcgagcagatccgccaggcgtgtatatagcgtggatggccaggcaactttagtgctgacacatacaggcatatatatatgtgtgcgacgacacatgatcatatggcatgcatgtgctctgtatgtatataaaactcttgttttcttcttttctctaaatattctttccttatacattaggtcctttgtagcataaattactatacttctatagacacgcaaacacaaatacacagcggccttgccaccatggccggcgcgcccactatgtgtgcggccgactgataactcgagcgatcctctagacgagctcctcgagcctgcagcagctgaagctttggacttcttcgccagaggtttggtcaagtctccaatcaaggttgtcggcttgtctaccttgccagaaatttacgaaaagatggaaaagggtcaaatcgttggtagatacgttgttgacacttctaaataagcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgcatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgcctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcgaccgcggatctgccggtctccctatagtgagtcgtattaatttcgataagccaggttaacctgcattaatgaatcggccaacgcgcggggagaggcggtttgcgtattgggcgctcttccgcttcctcgctcactgactcgctgcgctcggtcgttcggctgcggcgagcggtatcagcatcgatgaattccacggactatagactatactagtatactccgtctactgtacgatacacttccgctcaggtccttgtcctttaacgaggccttaccactcttttgttactctattgatccagctcagcaaaggcagtgtgatctaagattctatcttcgcgatgtagtaaaactagctagaccgagaaagagactagaaatgcaaaaggcacttctacaatggctgccatcattattatccgatgtgacgctgcagcttctcaatgatattcgaatacgctttgaggagatacagcctaatatccgacaaactgttttacagatttacgatcgtacttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatatgcatagtaccgagaaactagtgcgaagtagtgatcaggtattgctgttatctgatgagtatacgttgtcctggccacggcagaagcacgcttatcgctccaatttcccacaacattagtcaactccgttaggcccttcattgaaagaaatgaggtcatcaaatgtcttccaatgtgagattttgggccattttttatagcaaagattgaataaggcgcatttttcttcaaagctttattgtacgatctgactaagttatcttttaataattggtattcctgtttattgcttgaagaattgccggtcctatttactcgttttaggactggttcagaattcatcgatgctcactcaaaggtcggtaatacggttatccacagaatcaggggataacgcaggaaagaac

SEQ ID NO: 666 - DNA, 41 bp, Artificial sequence
  synthetic polynucleotide: C_N_RAGAvr05
tgtttatggttacttataggtatatataaacctaaccctct

SEQ ID NO: 667 - DNA, 42 bp, Artificial sequence
  synthetic polynucleotide: C_N_RAGAvr06
tgtttatggttacttataaggtatatataaacctaaccctct

SEQ ID NO: 668 - DNA, 43 bp, Artificial sequence
  synthetic polynucleotide: C_N_RAGAvr07
tgtttatggttacttataaggtactatataaacctaaccctct

SEQ ID NO: 669 - DNA, 44 bp, Artificial sequence
  synthetic polynucleotide: C_N_RAGAvr08
tgtttatggttacttatgaaggtactatataaacctaaccctct

SEQ ID NO: 670 - DNA, 45 bp, Artificial sequence
  synthetic polynucleotide: C_N_RAGAvr09
tgtttatggttacttatgaaggtacctatataaacctaaccctct

SEQ ID NO: 671 - DNA, 46 bp, Artificial sequence
  synthetic polynucleotide: C_N_RAGAvr10
tgtttatggttacttattgaaggtacctatataaacctaaccctct

SEQ ID NO: 672 - DNA, 47 bp, Artificial sequence
  synthetic polynucleotide: C_N_RAGAvr11
tgtttatggttacttattgaaggtaccttatataaacctaaccctct

SEQ ID NO: 673 - DNA, 48 bp, Artificial sequence
  synthetic polynucleotide: C_N_RAGAvr12
tgtttatggttacttatatgaaggtaccttatataaacctaaccctct

SEQ ID NO: 674 - DNA, 49 bp, Artificial sequence
  synthetic polynucleotide: C_N_RAGAvr13
tgtttatggttacttatatgaaggtacctttatataaacctaaccctct

SEQ ID NO: 675 - DNA, 50 bp, Artificial sequence
  synthetic polynucleotide: C_N_RAGAvr14
tgtttatggttacttatcatgaaggtacctttatataaacctaaccctct

SEQ ID NO: 676 - DNA, 51 bp, Artificial sequence
  synthetic polynucleotide: C_N_RAGAvr15
tgtttatggttacttattagcatgaaggtacctatataaacctaaccctct

SEQ ID NO: 677 - DNA, 52 bp, Artificial sequence
  synthetic polynucleotide: C_N_RAGAvr16
tgtttatggttacttatgcatgaaggtaccttgtatataaacctaaccctct

SEQ ID NO: 678 - DNA, 53 bp, Artificial sequence
  synthetic polynucleotide: C_N_RAGAvr17
tgtttatggttacttatgcatgaaggtaccttgttatataaacctaaccctct

SEQ ID NO: 679 - DNA, 54 bp, Artificial sequence
  synthetic polynucleotide: C_N_RAGAvr18
tgtttatggttacttatagcatgaaggtaccttgttatataaacctaaccctct

SEQ ID NO: 680 - DNA, 55 bp, Artificial sequence
  synthetic polynucleotide: C_N_RAGAvr19
tgtttatggttacttatagcatgaaggtaccttgtctatataaacctaaccctct

SEQ ID NO: 681 - DNA, 56 bp, Artificial sequence
  synthetic polynucleotide: C_N_RAGAvr20
tgtttatggttacttattagcatgaaggtaccttgtctatataaacctaaccctct

SEQ ID NO: 682 - DNA, 57 bp, Artificial sequence
  synthetic polynucleotide: C_N_RAGAvr21
tgtttatggttacttattagcatgaaggtaccttgtcgtatataaacctaaccctct

SEQ ID NO: 683 - DNA, 58 bp, Artificial sequence
  synthetic polynucleotide: C_N_RAGAvr22
tgtttatggttacttattagcatgaaggtaccttgtcgttatataaacctaaccctct

SEQ ID NO: 684 - DNA, 59 bp, Artificial sequence
  synthetic polynucleotide: C_N_RAGAvr23
tgtttatggttacttatctagcatgaaggtaccttgtcgttatataaacctaaccctct

SEQ ID NO: 685 - DNA, 60 bp, Artificial sequence
  synthetic polynucleotide: C_N_RAGAvr24
tgtttatggttacttatctagcatgaaggtaccttgtcgtttatataaacctaaccctct

SEQ ID NO: 686 - DNA, 61 bp, Artificial sequence
  synthetic polynucleotide: C_N_RAGAvr25
tgtttatggttacttatactagcatgaaggtaccttgtcgtttatataaacctaaccctct

SEQ ID NO: 687 - DNA, 62 bp, Artificial sequence
  synthetic polynucleotide: C_N_RAGAvr26
tgtttatggttacttatactagcatgaaggtaccttgtcgttgtatataaacctaaccctct

SEQ ID NO: 688 - DNA, 63 bp, Artificial sequence
  synthetic polynucleotide: C_N_RAGAvr27
tgtttatggttacttatcactagcatgaaggtaccttgtcgttgtatataaacctaaccctct

SEQ ID NO: 689 - DNA, 64 bp, Artificial sequence
  synthetic polynucleotide: C_N_RAGAvr28
tgtttatggttacttatcactagcatgaaggtaccttgtcgttgatatataaacctaaccctct

SEQ ID NO: 690 - DNA, 65 bp, Artificial sequence
  synthetic polynucleotide: C_N_RAGAvr29
tgtttatggttacttatccactagcatgaaggtaccttgtcgttgatatataaacctaaccctct

SEQ ID NO: 691 - DNA, 66 bp, Artificial sequence
  synthetic polynucleotide: C_N_RAGAvr30
tgtttatggttacttatccactagcatgaaggtaccttgtcgttgattatataaacctaaccctct

SEQ ID NO: 692 - DNA, 67 bp, Artificial sequence
  synthetic polynucleotide: C_N_RAGAvr31
tgtttatggttacttataccactagcatgaaggtaccttgtcgttgattatataaacctaaccctct

SEQ ID NO: 693 - DNA, 68 bp, Artificial sequence
  synthetic polynucleotide: C_N_RAGAvr32
tgtttatggttacttataccactagcatgaaggtaccttgtcgttgatttatataaacctaaccctct

SEQ ID NO: 694 - DNA, 69 bp, Artificial sequence
  synthetic polynucleotide: C_N_RAGAvr33
tgtttatggttacttatgaccactagcatgaaggtaccttgtcgttgatttatataaacctaaccctct

SEQ ID NO: 695 - DNA, 70 bp, Artificial sequence
  synthetic polynucleotide: C_N_RAGAvr34
tgtttatggttacttatgaccactagcatgaaggtaccttgtcgttgattctatataaacctaaccctct

SEQ ID NO: 696 - DNA, 71 bp, Artificial sequence
  synthetic polynucleotide: C_N_RAGAvr35
tgtttatggttacttattgaccactagcatgaaggtaccttgtcgttgattctatataaacctaaccctct

SEQ ID NO: 697 - DNA, 72 bp, Artificial sequence
  synthetic polynucleotide: C_N_RAGAvr36
tgtttatggttacttattgaccactagcatgaaggtaccttgtcgttgattcatatataaacctaaccctct

SEQ ID NO: 698 - DNA, 73 bp, Artificial sequence
  synthetic polynucleotide: C_N_RAGAvr37
tgtttatggttacttatctgaccactagcatgaaggtaccttgtcgttgattcatatataaacctaaccctct

SEQ ID NO: 699 - DNA, 74 bp, Artificial sequence
  synthetic polynucleotide: C_N_RAGAvr38
tgtttatggttacttatctgaccactagcatgaaggtaccttgtcgttgattcagtatataaacctaaccctct

SEQ ID NO: 700 - DNA, 75 bp, Artificial sequence
  synthetic polynucleotide: C_N_RAGAvr39
tgtttatggttacttattctgaccactagcatgaaggtaccttgtcgttgattcagtatataaacctaaccctct

SEQ ID NO: 701 - DNA, 76 bp, Artificial sequence
  synthetic polynucleotide: C_N_RAGAvr40
tgtttatggttacttattctgaccactagcatgaaggtaccttgtcgttgattcagttatataaacctaaccctct

---

The invention claimed is:

1. A method for targeted DNA cleavage within a mitochondrial DNA comprising:

providing a cell comprising a DNA target sequence within its mitochondrial DNA;

providing a nucleic acid encoding a TALEN that cleaves the DNA target sequence within the target cell; and expressing the TALEN in the target cell;

wherein the TALEN comprises a mitochondrial localization sequence, and wherein the TALEN has between 9.5 and 11.5 RVDs and shows increased sensitivity of TALEN toward DNA/protein mismatch at N or N-1 positions relative to a TALEN with 15.5 RVDs.

2. The method of claim 1, wherein the cell is a primary cell.

3. The method of claim 1, wherein the cell is a human cell.

4. The method of claim 2, wherein the cell is a human cell.

5. The method of claim 2, wherein the TALEN comprises an amino acid sequence having at least 95% identity with SEQ ID NO: 600.

6. The method of claim 1, wherein the TALEN has 9.5 RVDs.

7. The method of claim 2, wherein the TALEN has 9.5 RVDs.

8. The method of claim 3, wherein the TALEN has 9.5 RVDs.

9. The method of claim 4, wherein the TALEN has 9.5 RVDs.

10. The method of claim 5, wherein the TALEN has 9.5 RVDs.

11. The method of claim 1, wherein the TALEN has 11.5 RVDs.

12. The method of claim 2, wherein the TALEN has 11.5 RVDs.

13. The method of claim 3, wherein the TALEN has 11.5 RVDs.

14. The method of claim 4, wherein the TALEN has 11.5 RVDs.

15. The method of claim 5, wherein the TALEN has 11.5 RVDs.

16. The method of claim 1, wherein the mitochondrial signal is located in the Nter domain of the TALEN.

17. The method of claim 1, wherein the mitochondrial signal is located in the Cter domain of the TALEN.

* * * * *